US008987414B2

(12) United States Patent
Guerlavais et al.

(10) Patent No.: US 8,987,414 B2
(45) Date of Patent: Mar. 24, 2015

(54) TRIAZOLE-CROSSLINKED AND THIOETHER-CROSSLINKED PEPTIDOMIMETIC MACROCYCLES

(71) Applicant: Aileron Therapeutics, Inc., Cambridge, MA (US)

(72) Inventors: Vincent Guerlavais, Arlington, MA (US); Christopher R. Conlee, Belmont, MA (US); Scott Paul Lentini, North Weymouth, MA (US)

(73) Assignee: Aileron Therapeutics, Inc., Cambridge, MA (US)

( * ) Notice: Subject to any disclaimer, the term of this patent is extended or adjusted under 35 U.S.C. 154(b) by 0 days.

(21) Appl. No.: 13/767,857

(22) Filed: Feb. 14, 2013

(65) Prior Publication Data
US 2013/0210745 A1  Aug. 15, 2013

Related U.S. Application Data

(62) Division of application No. 61/599,363, filed on Feb. 15, 2012.

(60) Provisional application No. 61/723,762, filed on Nov. 7, 2012, provisional application No. 61/599,365, filed on Feb. 15, 2012, provisional application No. 61/723,767, filed on Nov. 7, 2012.

(51) Int. Cl.
A61K 38/12 (2006.01)
C07K 5/00 (2006.01)
C07K 7/00 (2006.01)
C07K 16/00 (2006.01)
C07K 17/00 (2006.01)
A61K 38/00 (2006.01)
A61P 35/00 (2006.01)
C07K 7/56 (2006.01)

(52) U.S. Cl.
CPC ........................ C07K 7/56 (2013.01)
USPC .......... 530/321; 530/317; 514/19.3; 514/19.9

(58) Field of Classification Search
None
See application file for complete search history.

(56) References Cited

U.S. PATENT DOCUMENTS

| 4,270,537 A | 6/1981 | Romaine |
| 4,596,556 A | 6/1986 | Morrow et al. |
| 4,730,006 A | 3/1988 | Bohme et al. |
| 4,790,824 A | 12/1988 | Morrow et al. |
| 4,886,499 A | 12/1989 | Cirelli et al. |
| 4,940,460 A | 7/1990 | Casey et al. |
| 4,941,880 A | 7/1990 | Burns |
| 5,015,235 A | 5/1991 | Crossman |
| 5,064,413 A | 11/1991 | McKinnon et al. |
| 5,141,496 A | 8/1992 | Dalto et al. |
| 5,190,521 A | 3/1993 | Hubbard et al. |
| 5,310,910 A | 5/1994 | Drtina et al. |
| 5,312,335 A | 5/1994 | McKinnon et al. |
| 5,328,483 A | 7/1994 | Jacoby |
| 5,334,144 A | 8/1994 | Alchas et al. |
| 5,339,163 A | 8/1994 | Homma et al. |
| 5,364,851 A | 11/1994 | Joran |
| 5,383,851 A | 1/1995 | McKinnon et al. |
| 5,417,662 A | 5/1995 | Hjertman et al. |
| 5,446,128 A | 8/1995 | Kahn et al. |
| 5,466,220 A | 11/1995 | Brenneman |
| 5,480,381 A | 1/1996 | Weston |
| 5,503,627 A | 4/1996 | McKinnon et al. |
| 5,520,639 A | 5/1996 | Peterson et al. |
| 5,527,288 A | 6/1996 | Gross et al. |
| 5,569,189 A | 10/1996 | Parsons |
| 5,599,302 A | 2/1997 | Lilley et al. |
| 5,622,852 A | 4/1997 | Korsmeyer |
| 5,649,912 A | 7/1997 | Peterson |
| 5,663,316 A | 9/1997 | Xudong |
| 5,672,584 A | 9/1997 | Borchardt et al. |
| 5,702,908 A | 12/1997 | Picksley et al. |
| 5,704,911 A | 1/1998 | Parsons |
| 5,708,136 A | 1/1998 | Burrell et al. |
| 5,750,767 A | 5/1998 | Carpino et al. |
| 5,756,669 A | 5/1998 | Bischoff et al. |
| 5,770,377 A | 6/1998 | Picksley et al. |
| 5,811,515 A | 9/1998 | Grubbs et al. |
| 5,824,483 A | 10/1998 | Houston, Jr. et al. |
| 5,834,209 A | 11/1998 | Korsmeyer |
| 5,856,445 A | 1/1999 | Korsmeyer |
| 5,874,529 A | 2/1999 | Gilon et al. |
| 5,893,397 A | 4/1999 | Peterson et al. |
| 5,922,863 A | 7/1999 | Grubbs et al. |

(Continued)

FOREIGN PATENT DOCUMENTS

| CZ | 9700369 A3 | 9/1998 |
| EP | 0528312 A2 | 2/1993 |

(Continued)

OTHER PUBLICATIONS

Hu et al, Efficient p53 Activation and Apoptosis by Simultaneous Disruption of Binding to MDM2 and MDMX, Cancer Res 2007;67:8810-8817.*

Annis, et al. A general technique to rank protein-ligand binding affinities and determine allosteric versus direct binding site competition in compound mixtures. J Am Chem Soc. Dec. 1, 2004;126(47):15495-503.

Annis, et al. ALIS: An Affinity Selection-Mass Spectrometry System for the Discovery and Characterization of Protein-Ligand Interactions. In: Wanner, K. and Höfner, G. eds. Mass Spectrometry in Medicinal Chemistry. Wiley-VCH; 2007:121-156.

Belokon, et al. Improved procedures for the synthesis of (s)-2-[N-(N'-benzylprolyl)amino]benzophenone (BPB) and Ni(II) complexes of Schiff's bases derived from BPB and amino acids. Tetrahedron Asymm Dec. 11, 1998;9(23):4249-4252.

Brunel, F.M. and Dawson, P.E. Synthesis of constrained helical peptides by thioether ligation: application to analogs of gp41. Chem. Commun. (Camb.) May 28, 2005;(20):2552-4.

(Continued)

Primary Examiner — Marcela M Cordero Garcia
Assistant Examiner — Sergio Coffa
(74) Attorney, Agent, or Firm — Wilson Sonsini Goodrich & Rosati, P.C.

(57) ABSTRACT

Provided herein are peptidomimetic macrocycles and methods of using such macrocycles for the treatment of disease.

44 Claims, No Drawings

(56) References Cited

U.S. PATENT DOCUMENTS

| | | |
|---|---|---|
| 5,955,593 A | 9/1999 | Korsmeyer |
| 5,965,703 A | 10/1999 | Horne et al. |
| 5,993,412 A | 11/1999 | Deily et al. |
| 5,998,583 A | 12/1999 | Korsmeyer |
| 6,030,997 A | 2/2000 | Eilat et al. |
| 6,043,339 A | 3/2000 | Lin et al. |
| 6,046,289 A | 4/2000 | Komazawa et al. |
| 6,051,554 A | 4/2000 | Hornik et al. |
| 6,153,391 A | 11/2000 | Picksley et al. |
| 6,169,073 B1 | 1/2001 | Halazonetis et al. |
| 6,184,344 B1 | 2/2001 | Kent et al. |
| 6,245,886 B1 | 6/2001 | Halazonetis et al. |
| 6,271,198 B1 | 8/2001 | Braisted et al. |
| 6,326,354 B1 | 12/2001 | Gross et al. |
| 6,420,118 B1 | 7/2002 | Halazonetis et al. |
| 6,420,136 B1 * | 7/2002 | Riabowol et al. ............ 435/69.1 |
| 6,495,674 B1 | 12/2002 | Lemke et al. |
| 6,569,993 B1 | 5/2003 | Sledeski et al. |
| 6,610,657 B1 | 8/2003 | Goueli |
| 6,613,874 B1 | 9/2003 | Mazur et al. |
| 6,703,382 B2 | 3/2004 | Wang et al. |
| 6,713,280 B1 | 3/2004 | Huang et al. |
| 6,784,157 B2 | 8/2004 | Halazonetis et al. |
| 6,849,428 B1 | 2/2005 | Evans et al. |
| 6,875,594 B2 | 4/2005 | Muir et al. |
| 7,064,193 B1 | 6/2006 | Cory et al. |
| 7,083,983 B2 | 8/2006 | Lane et al. |
| 7,084,244 B2 | 8/2006 | Gilon et al. |
| 7,183,059 B2 | 2/2007 | Verdine et al. |
| 7,189,801 B2 | 3/2007 | Halazonetis et al. |
| 7,192,713 B1 | 3/2007 | Verdine et al. |
| 7,202,332 B2 | 4/2007 | Arora et al. |
| 7,247,700 B2 | 7/2007 | Korsmeyer et al. |
| 7,538,190 B2 | 5/2009 | Robinson et al. |
| 7,666,983 B2 | 2/2010 | Halazonetis et al. |
| 7,705,118 B2 | 4/2010 | Arora et al. |
| 7,723,469 B2 | 5/2010 | Walensky et al. |
| 7,737,174 B2 | 6/2010 | Wang et al. |
| 7,745,573 B2 | 6/2010 | Robinson et al. |
| 7,759,383 B2 | 7/2010 | Wang et al. |
| 7,786,072 B2 | 8/2010 | Verdine et al. |
| 7,884,107 B2 | 2/2011 | Ma et al. |
| 7,893,278 B2 | 2/2011 | Haley et al. |
| 7,927,813 B2 | 4/2011 | Geneste et al. |
| 7,932,397 B2 | 4/2011 | Hock et al. |
| 7,960,506 B2 | 6/2011 | Nash et al. |
| 7,964,724 B2 | 6/2011 | Fotouhi et al. |
| 7,981,999 B2 | 7/2011 | Nash |
| 8,017,607 B2 | 9/2011 | Bartkovitz et al. |
| 8,058,269 B2 | 11/2011 | Chen et al. |
| 8,071,541 B2 | 12/2011 | Arora et al. |
| 8,076,482 B2 | 12/2011 | Chen et al. |
| 8,088,815 B2 | 1/2012 | Bartkovitz et al. |
| 8,088,931 B2 | 1/2012 | Wang et al. |
| 8,124,726 B2 | 2/2012 | Robinson et al. |
| 8,198,405 B2 | 6/2012 | Walensky et al. |
| 8,217,051 B2 | 7/2012 | Zhang et al. |
| 8,324,428 B2 | 12/2012 | Verdine et al. |
| 8,343,760 B2 | 1/2013 | Lu et al. |
| 2002/0098580 A1 | 7/2002 | Nandabalan et al. |
| 2002/0132977 A1 | 9/2002 | Yuan et al. |
| 2003/0027766 A1 | 2/2003 | Ioannides et al. |
| 2003/0060432 A1 | 3/2003 | Tocque et al. |
| 2003/0144331 A1 | 7/2003 | Gudkov et al. |
| 2003/0176318 A1 | 9/2003 | Gudkov et al. |
| 2004/0023887 A1 | 2/2004 | Pillutla et al. |
| 2004/0038901 A1 | 2/2004 | Basler et al. |
| 2004/0067503 A1 | 4/2004 | Tan et al. |
| 2004/0115135 A1 | 6/2004 | Quay |
| 2004/0146971 A1 | 7/2004 | Lane et al. |
| 2004/0170653 A1 | 9/2004 | Stanislawski et al. |
| 2004/0170971 A1 | 9/2004 | Kinzler et al. |
| 2004/0171809 A1 | 9/2004 | Korsmeyer et al. |
| 2004/0228866 A1 | 11/2004 | Lu |
| 2004/0235746 A1 | 11/2004 | Hawiger et al. |
| 2004/0248198 A1 | 12/2004 | Kriwacki et al. |
| 2004/0265931 A1 | 12/2004 | Gu et al. |
| 2005/0013820 A1 | 1/2005 | Holoshitz et al. |
| 2005/0037383 A1 | 2/2005 | Taremi et al. |
| 2005/0089511 A1 | 4/2005 | Roth et al. |
| 2005/0137137 A1 | 6/2005 | Lane et al. |
| 2005/0176075 A1 | 8/2005 | Jones et al. |
| 2005/0222224 A1 | 10/2005 | Gudkov et al. |
| 2005/0227932 A1 | 10/2005 | Lu et al. |
| 2005/0250680 A1 | 11/2005 | Walensky et al. |
| 2005/0277764 A1 | 12/2005 | Boyd et al. |
| 2006/0008848 A1 | 1/2006 | Verdine et al. |
| 2006/0014675 A1 | 1/2006 | Arora et al. |
| 2006/0100143 A1 | 5/2006 | Lu et al. |
| 2006/0149039 A1 | 7/2006 | Hunter et al. |
| 2006/0189511 A1 | 8/2006 | Koblish et al. |
| 2006/0233779 A1 | 10/2006 | Ben-Avraham et al. |
| 2007/0006332 A1 | 1/2007 | O'Neil |
| 2007/0032417 A1 | 2/2007 | Baell |
| 2007/0129324 A1 | 6/2007 | Boyd et al. |
| 2007/0274915 A1 | 11/2007 | Rao et al. |
| 2008/0081038 A1 | 4/2008 | Cho et al. |
| 2008/0085279 A1 | 4/2008 | Boyd et al. |
| 2008/0132485 A1 | 6/2008 | Wang et al. |
| 2008/0161426 A1 | 7/2008 | Gudkov et al. |
| 2008/0242598 A1 | 10/2008 | Fairlie et al. |
| 2008/0262200 A1 | 10/2008 | Nash |
| 2008/0305490 A1 | 12/2008 | Burrell et al. |
| 2008/0311608 A1 | 12/2008 | Tocque et al. |
| 2009/0047711 A1 | 2/2009 | Nash |
| 2009/0088553 A1 | 4/2009 | Nash |
| 2009/0149630 A1 | 6/2009 | Walensky et al. |
| 2009/0176964 A1 | 7/2009 | Walensky et al. |
| 2009/0311174 A1 * | 12/2009 | Allen .......................... 424/1.49 |
| 2009/0326192 A1 * | 12/2009 | Nash et al. .................. 530/317 |
| 2010/0010065 A1 | 1/2010 | Smith |
| 2010/0081611 A1 | 4/2010 | Bradner et al. |
| 2010/0093057 A1 | 4/2010 | Beattie et al. |
| 2010/0093086 A1 | 4/2010 | Lin et al. |
| 2010/0168388 A1 | 7/2010 | Bernal et al. |
| 2010/0184628 A1 | 7/2010 | Nash |
| 2010/0184645 A1 | 7/2010 | Verdine et al. |
| 2010/0210515 A1 | 8/2010 | Nash et al. |
| 2010/0216688 A1 | 8/2010 | Nash et al. |
| 2010/0234563 A1 | 9/2010 | Arora et al. |
| 2010/0286362 A1 | 11/2010 | Boyd et al. |
| 2010/0298201 A1 | 11/2010 | Nash et al. |
| 2011/0021529 A1 | 1/2011 | Lain et al. |
| 2011/0028753 A1 | 2/2011 | Verdine et al. |
| 2011/0065915 A1 | 3/2011 | Malcolmson et al. |
| 2011/0144303 A1 | 6/2011 | Nash et al. |
| 2011/0144306 A1 | 6/2011 | Verdine et al. |
| 2011/0183917 A1 | 7/2011 | Lu et al. |
| 2011/0218155 A1 | 9/2011 | Walensky et al. |
| 2011/0223149 A1 | 9/2011 | Nash et al. |
| 2011/0245477 A1 | 10/2011 | Hoveyda et al. |
| 2011/0251252 A1 | 10/2011 | Wang et al. |
| 2011/0263815 A1 | 10/2011 | Nash |
| 2011/0313167 A1 | 12/2011 | Doemling |
| 2012/0082636 A1 | 4/2012 | Walensky et al. |
| 2012/0156197 A1 | 6/2012 | Errico et al. |
| 2012/0172311 A1 | 7/2012 | Nash et al. |
| 2012/0190818 A1 | 7/2012 | Nash et al. |
| 2012/0238507 A1 | 9/2012 | Fairlie et al. |
| 2012/0264738 A1 | 10/2012 | Sugimoto et al. |
| 2012/0270800 A1 | 10/2012 | Verdine et al. |
| 2012/0283269 A1 | 11/2012 | Blagosklonny et al. |
| 2012/0328692 A1 | 12/2012 | Lu et al. |
| 2013/0005943 A1 | 1/2013 | Arora et al. |
| 2013/0023646 A1 | 1/2013 | Nash et al. |
| 2013/0211046 A1 | 8/2013 | Verdine et al. |
| 2013/0330421 A1 | 12/2013 | Marine |

(56) References Cited

U.S. PATENT DOCUMENTS

| | | |
|---|---|---|
| 2014/0005118 A1 | 1/2014 | Verdine et al. |
| 2014/0011979 A1 | 1/2014 | Verdine et al. |
| 2014/0018302 A1 | 1/2014 | Walensky et al. |

FOREIGN PATENT DOCUMENTS

| | | |
|---|---|---|
| EP | 0552417 A1 | 7/1993 |
| EP | 0643726 B1 | 8/1999 |
| EP | 0977580 B1 | 4/2003 |
| EP | 1321474 A1 | 6/2003 |
| EP | 1609802 A1 | 12/2005 |
| EP | 1243923 B1 | 3/2006 |
| EP | 1180016 B1 | 9/2006 |
| EP | 0958305 B1 | 6/2008 |
| EP | 2377849 A2 | 10/2011 |
| JP | 2002-524391 | 8/2002 |
| JP | 2010/120881 A | 6/2010 |
| WO | WO 92/06998 A1 | 4/1992 |
| WO | WO 93/07170 A1 | 4/1993 |
| WO | WO 94/22910 A1 | 10/1994 |
| WO | WO 95/22546 A1 | 8/1995 |
| WO | WO 96/34878 A1 | 11/1996 |
| WO | WO 97/13537 A1 | 4/1997 |
| WO | WO 97/14794 A1 | 4/1997 |
| WO | WO 97/37705 A1 | 10/1997 |
| WO | WO 98/17625 A1 | 4/1998 |
| WO | WO 99/34850 A1 | 7/1999 |
| WO | WO 99/63929 A2 | 12/1999 |
| WO | WO 00/06187 A2 | 2/2000 |
| WO | WO 00/06187 A3 | 5/2000 |
| WO | WO 02/064790 A2 | 8/2002 |
| WO | WO 02/070547 A1 | 9/2002 |
| WO | WO 02/064790 A3 | 5/2003 |
| WO | WO 03/054000 A1 | 7/2003 |
| WO | WO 03/102538 A2 | 12/2003 |
| WO | WO 03/106491 A2 | 12/2003 |
| WO | WO 2004/041275 A1 | 5/2004 |
| WO | WO 2004/058804 A1 | 7/2004 |
| WO | WO 03/106491 A3 | 12/2004 |
| WO | WO 2005/040202 A2 | 5/2005 |
| WO | WO 2005/044839 A2 | 5/2005 |
| WO | WO 2005/040202 A3 | 6/2005 |
| WO | WO 2005/044839 A3 | 7/2005 |
| WO | WO 2005/074521 A2 | 8/2005 |
| WO | WO 2005/085457 A2 | 9/2005 |
| WO | WO 2005/090388 A1 | 9/2005 |
| WO | WO 2005/118620 A2 | 12/2005 |
| WO | WO 2005/118634 A2 | 12/2005 |
| WO | WO 2005/118634 A3 | 5/2006 |
| WO | WO 2005/118620 A3 | 6/2006 |
| WO | WO 2006/103666 A2 | 10/2006 |
| WO | WO 2006/103666 A3 | 3/2007 |
| WO | WO 2007/141533 A2 | 12/2007 |
| WO | WO 2008/014216 A1 | 1/2008 |
| WO | WO 2008/045238 A2 | 4/2008 |
| WO | WO 2008/061192 A2 | 5/2008 |
| WO | WO 2007/141533 A3 | 7/2008 |
| WO | WO 2008/061192 A3 | 7/2008 |
| WO | WO 2008/092281 A1 | 8/2008 |
| WO | WO 2008/095063 A1 | 8/2008 |
| WO | WO 2008/104000 A2 | 8/2008 |
| WO | WO 2008/106507 A2 | 9/2008 |
| WO | WO 2008/121767 A2 | 10/2008 |
| WO | WO 2008/121767 A3 | 1/2009 |
| WO | WO 2009/137532 A1 | 11/2009 |
| WO | WO 2010/011313 A2 | 1/2010 |
| WO | WO 2010/013011 A1 | 2/2010 |
| WO | WO 2010/058819 A1 | 5/2010 |
| WO | WO 2010/083501 A2 | 7/2010 |
| WO | WO 2010/100351 A1 | 9/2010 |
| WO | WO 2010/107485 A1 | 9/2010 |
| WO | WO 2010/011313 A3 | 12/2010 |
| WO | WO 2011/005219 A1 | 1/2011 |
| WO | WO 2011/008260 A2 | 1/2011 |
| WO | WO 2011/008260 A3 | 3/2011 |
| WO | WO 2011/023677 A1 | 3/2011 |
| WO | WO 2011/060049 A2 | 5/2011 |
| WO | WO 2011/061139 A1 | 5/2011 |
| WO | WO 2011/076786 A1 | 6/2011 |
| WO | WO 2011/090297 A2 | 7/2011 |
| WO | WO 2011/101297 A1 | 8/2011 |
| WO | WO 2011/106650 A2 | 9/2011 |
| WO | WO 2011/161699 A2 | 12/2011 |
| WO | WO 2012/016186 A1 | 2/2012 |
| WO | WO 2012/021876 A2 | 2/2012 |
| WO | WO 2012/033525 A2 | 3/2012 |
| WO | WO 2012/034954 A1 | 3/2012 |
| WO | WO 2012/038307 A1 | 3/2012 |
| WO | WO 2012/040459 A2 | 3/2012 |
| WO | WO 2012/045018 A1 | 4/2012 |
| WO | WO 2012/047587 A2 | 4/2012 |
| WO | WO 2012/051405 A1 | 4/2012 |
| WO | WO 2012/059696 A1 | 5/2012 |
| WO | WO 2012/065022 A2 | 5/2012 |
| WO | WO 2012/065181 A2 | 5/2012 |
| WO | WO 2012/066095 A1 | 5/2012 |
| WO | WO 2012/040459 A3 | 6/2012 |
| WO | WO 2012/076513 A1 | 6/2012 |
| WO | WO 2012/080389 A1 | 6/2012 |
| WO | WO 2012/083078 A2 | 6/2012 |
| WO | WO 2012/083181 A1 | 6/2012 |
| WO | WO 2012/121057 A1 | 9/2012 |
| WO | WO 2012/149563 A1 | 11/2012 |
| WO | WO 2012/174423 A1 | 12/2012 |
| WO | WO 2012/175962 A1 | 12/2012 |
| WO | WO 2013/033645 A1 | 3/2013 |
| WO | WO 2013/036208 A1 | 3/2013 |
| WO | WO 2013/049250 A1 | 4/2013 |

OTHER PUBLICATIONS

Deiters, et al. Adding amino acids with novel reactivity to the genetic code of Saccharomyces cerevisiae. J. Am. Chem. Soc. Oct. 1, 2003;125(39):11782-11783.

Fields, et al. Chapter 3 in Synthetic Peptides: A User's Guide. Grant W.H. Freeman & Co. New York, NY. 1992. p. 77.

Fieser, et al. Fieser and Fieser's Reagents for Organic Synthesis. John Wiley and Sons. 1994.

Galande, et al. An effective method of on-resin disulfide bond formation in peptides. J. Comb. Chem. Mar.-Apr. 2005;7(2):174-177.

Greene, et al. Protective Groups in Organic Synthesis, 2nd Ed. John Wiley and Sons. 1991.

Grubbs, et al. Ring Closing Metathesis and Related Processes in organic Synthesis. Acc. Chem. Res. 1995;28(11):446-452.

International search report and written report dated May 23, 2013 for PCT/US2013/026241.

Kallen, et al. Crystal structures of human MdmX(HdmX) in complex with p53 peptide analogues reveal surprising conformational changes. Journal of Biological Chemistry. Mar. 27, 2009; 284:8812-8821.

Larock. Comprehensive Organic Transformations. VCH Publishers. 1989.

Li, et al. A convenient preparation of 5-iodo-1,4-disubstituted-1,2,3-triazole: multicomponent one-pot reaction of azide and alkyne mediated by CuI-NBS. J Org Chem. May 2, 2008;73(9):3630-3. doi: 10.1021/jo800035v. Epub Mar. 22, 2008.

Li, et al. Systematic mutational analysis of peptide inhibition of the p53-MDM2/MDMX interactions. J Mol Biol. Apr. 30, 2010;398(2):200-13. doi: 10.1016/j.jmb.2010.03.005. Epub Mar. 10, 2010.

Mannhold, R., Kubinyi, H., Folkers, G., series eds. Molecular Drug Properties: Measurement and Prediction (Methods and Principles in Medicinal Chemistry). Wiley-VCH; 2007.

Mosberg, et al. Dithioeter-containing cyclic peptides. J. Am. Chem. Soc. 1985;107(10):2986-2987.

Mustapa, et al. Synthesis of a cyclic peptide containing norlanthionine: effect of the thioether bridge on peptide conformation. J Org Chem. Oct. 17, 2003;68(21):8193-8.

Or et al. Cysteine alkylation in unprotected peptides: synthesis of a carbavasopressin analogue by intramolecular cystein alkylation. J. Org. Chem. Apr. 1991;56(9):3146-3149.

(56) References Cited

OTHER PUBLICATIONS

Paquette. Encyclopedia of Reagents for Organic Synthesis. John Wiley and Sons. 1995.
Peryshkov, et al. Z-Selective olefin metathesis reactions promoted by tungsten oxo alkylidene complexes. J Am Chem Soc. Dec. 28, 2011;133(51):20754-7. doi: 10.1021/ja210349m. Epub Nov. 30, 2011.
Phan, et al. Structure-based design of high affinity peptides inhibiting the interaction of p53 with MDM2 and MDMX. J Biol Chem. Jan. 15, 2010;285(3):2174-83. doi: 10.1074/jbc.M109.073056. Epub Nov. 12, 2009.
Punna, et al. Head-to-tail peptide cyclodimerization by copper-catalyzed azide-alkyne cycloaddition. Angew Chem Int Ed Engl. Apr. 8, 2005;44(15):2215-20.
Rasmussen, et al. Ruthenium-catalyzed cycloaddition of aryl azides and alkynes. Org. Lett. Dec. 20, 2007;9(26):5337-5339.
Rostovtsev, et al. A stepwise huisgen cycloaddition process: copper (i)-catalyzed regioselective "ligation" of azides and terminal alkynes. Angew. Chem. Int. Ed. Engl. Jul. 15, 2002;41(14):2596-2599.
Seebach, et al. Self-Regeneration of Stereocenters (SRS)—Applications, Limitations, and Abandonment of a Synthetic Principle. Angew. Chem. Int. Ed. Engl. 1996;35:2708-2748.
Tornoe, et al. Peptidotriazoles on solid phase: [1,2,3]-triazoles by regiospecific copper(i)-catalyzed 1,3-dipolar cycloadditions of terminal alkynes to azides. J. Org. Chem. May 3, 2002;67(9):3057-64.
Vaickus, et al. Immune markers in hematologic malignancies. Crit. Rev. Oncol. Hematol. Dec. 1991;11(4):267-97.
Wu, et al. Regiospecific Synthesis of 1,4,5-Trisubstituted-1,2,3-triazole via One-Pot Reaction Promoted by Copper(I) Salt. Synthesis. 2005(8): 1314-1318.
Yang et al. Synthesis and helical structure of lactam bridged BH3 peptides derived from pro-apoptotic Bcl-2 family proteins. Bioorg Med Chem Lett. Mar. 22, 2004;14(6):1403-6.
Yang, et al. Calculation of protein conformation from circular dichroism. Methods Enzymol. 1986;130:208-69.
Yu, et al. Synthesis of macrocyclic natural products by catalyst-controlled stereoselective ring-closing metathesis. Nature. Nov. 2, 2011;479(7371):88-93. doi: 10.1038/nature10563.
Zhang, et al. Ruthenium-catalyzed cycloaddition of alkynes and organic azides. J. Am. Chem. Soc. Nov. 23, 2005;127(46):15998-9.
Office action dated Sep. 23, 2013 for U.S. Appl. No. 13/680,905.
Office action dated Oct. 10, 2013 for U.S. Appl. No. 13/816,880.
U.S. Appl. No. 61/385,405, filed Sep. 22, 2010, Verdine et al.
U.S. Appl. No. 13/494,846, filed Jun. 12, 2012, Nash et al.
U.S. Appl. No. 13/680,905, filed Nov. 19, 2012, Verdine et al.
U.S. Appl. No. 13/767,852, filed Feb. 14, 2013, Guerlavais et al.
U.S. Appl. No. 13/816,880, filed Feb. 13, 2013, Guerlavais et al.
Adhikary, et al. Transcriptional regulation and transformation by Myc proteins. Nat Rev Mol Cell Biol. Aug. 2005;6(8):635-45.
Agola et al., Rab GTPases as regulators of endocytosis, targets of disease and therapeutic opportunities. Clin Genet. Oct. 2011; 80(4): 305-318.
Altschul et al., Basic local alignment search tool. J Mol Biol. Oct. 5, 1990;215(3):403-10.
Aman, et al. cDNA cloning and characterization of the human interleukin 13 receptor alpha chain. J Biol Chem. Nov. 15, 1996;271(46):29265-70.
Andrews, et al. Forming Stable Helical Peptides Using Natural and Artificial Amino Acids. Tetrahedron 55:11711-11743 (1999).
Andrews, et al. Kinetic analysis of the interleukin-13 receptor complex. J Biol Chem. Nov. 29, 2002;277(48):46073-8.
Armstrong, et al. X = Y-ZH Systems as potential 1,3-dipoles. 5. Intramolecular cycloadditions of imines of a-amino acid esters. Tetrahedron. 1985;41(17):3547-58.
Attisano, et al. TGFbeta and Wnt pathway cross-talk. Cancer Metastasis Rev. Jan.-Jun. 2004;23(1-2):53-61.
Austin et al., "A Template for Stabilization of a Peptide α-Helix: Synthesis and Evaluation of Conformational Effects by Circular Dichroism and NMR," J. Am. Chem. Soc. 119:6461-6472 (1997).

Babine, et al. Molecular Recognition of Proteinminus signLigand Complexes: Applications to Drug Design. Chem Rev. Aug. 5, 1997;97(5):1359-1472.
Baek, et al. Structure of the stapled p53 peptide bound to Mdm2. J Am Chem Soc. Jan. 11, 2012;134(1):103-6. doi: 10.1021/ja2090367. Epub Dec. 14, 2011.
Baell, J.B. Prospects for Targeting the Bcl-2 Family of Proteins to Develop Novel cytotoxic drugs. Biochem Pharmacol. Sep. 2002;64(5-6):851-63.
Bakhshi, et al. Cloning the chromosomal breakpoint of t(14;18) human lymphomas: clustering around JH on chromosome 14 and near a transcriptional unit on 18. Cell. Jul. 1985;41(3):899-906.
Banerjee, et al. Structure of a DNA glycosylase searching for lesions. Science. Feb. 24, 2006;311(5764):1153-7.
Banerjee, et al. Structure of a repair enzyme interrogating undamaged DNA elucidates recognition of damaged DNA. Nature. Mar. 31, 2005;434(7033):612-8.
Banerji et al., "Synthesis of Cyclic β-Turn Mimics from L-Pro-Phe/Phe-L-Pro Derived Di- and Tripeptides via Ring Closing Metathesis: The Role of Chirality of the Phe Residue During Cyclization," Tetrahedron Lett. 43:6473-6477 (2002).
Bang, et al. Total chemical synthesis of crambin. J Am Chem Soc. Feb. 11, 2004;126(5):1377-83.
Barandon, et al. Reduction of infarct size and prevention of cardiac rupture in transgenic mice overexpressing FrzA. Circulation. Nov. 4, 2003;108(18):2282-9. Epub Oct. 27, 2003.
Barker, et al. Mining the Wnt pathway for cancer therapeutics. Nat Rev Drug Discov. Dec. 2006;5(12):997-1014.
Beloken, et al. Chiral Complexes of Ni(II), Cu(II) and Cu(I) as Reagents, Catalysts and Receptors for Asymmetric Synthesis and Chiral Recognition of Amino Acids. Pure & Appl Chem. 1992;64(12):1917-24.
Bennett, et al. Regulation of osteoblastogenesis and bone mass by Wntl Ob. Proc Natl Acad Sci U S A. Mar. 1, 2005;102(9):3324-9.. Epub Feb. 22, 2005.
Berendsen et al., A glimpse of the Holy Grail? Science. Oct. 23, 1998;282(5389):642-3.
Berge, et al. Pharmaceutical salts. J Pharm Sci. Jan. 1977;66(1):1-19.
Bernal, et al. A stapled p53 helix overcomes HDMX-mediated suppression of p53. Cancer Cell. Nov. 16, 2010;18(5):411-22. doi: 10.1016/j.ccr.2010.10.024.
Bernal, et al. Reactivation of the p53 tumor suppressor pathway by a stapled p53 peptide. J Am Chem Soc. Mar. 7, 2007;129(9):2456-7.
Biagini, et al. Cross-metathesis of Unsaturated a-amino Acid Derivatives. J Chem Soc Perkin Trans. 1998;1:2485-99.
Bierzynski, et al. A salt bridge stabilizes the helix formed by isolated C-peptide of RNase A. Proc Natl Acad Sci U S A. Apr. 1982;79(8):2470-4.
Blackwell, et al. Highly efficient synthesis of covalently cross-linked peptide helices by ring-closing metathesis. Angew Chem Int Ed. 1994; 37(23):3281-84.
Blackwell, et al. Ring-closing metathesis of olefinic peptides: design, synthesis, and structural characterization of macrocyclic helical peptides. J Org Chem. Aug. 10, 2001;66(16):5291-302.
Blundell et al., Atomic positions in rhombohedral 2-zinc insulin crystals. Nature. Jun. 25, 1971;231(5304):506-11.
Bode, et al. Chemoselective amide ligations by decarboxylative condensations of N-alkylhydroxylamines and alpha-ketoacids. Angew Chem Int Ed Engl. Feb. 13, 2006;45(8):1248-52.
Boguslavsky, et al. Effect of peptide conformation on membrane permeability. J Pept Res. Jun. 2003;61(6):287-97.
Bossy-Wetzel, et al. Assays for cytochrome c release from mitochondria during apoptosis. Methods Enzymol. 2000;322:235-42.
Bossy-Wetzel, et al. Detection of apoptosis by annexin V labeling. Methods Enzymol. 2000;322:15-8.
Bottger, et al. Molecular characterization of the hdm2-p53 interaction. J Mol Biol. Jun. 27, 1997;269(5):744-56.
Boyden, et al. High bone density due to a mutation in LDL-receptor-related protein 5. N Engl J Med. May 16, 2002;346(20):1513-21.
Bracken, et al. Synthesis and nuclear magnetic resonance structure determination of an alpha-helical, bucyclic, lactam-bridged hexpeptide. J Am Chem Soc. 1994; 116:6431-32.

(56) References Cited

OTHER PUBLICATIONS

Bradley et al., Limits of cooperativity in a structurally modular protein: response of the Notch ankyrin domain to analogous alanine substitutions in each repeat. J Mol Biol. Nov. 22, 2002;324(2):373-86.

Brandt et al., Dimeric fragment of the insulin receptor alpha-subunit binds insulin with full holoreceptor affinity. J Biol Chem. Apr. 13, 2001;276(15):12378-84. Epub Jan. 12, 2001.

Brubaker, et al. Solution structure of the interacting domains of the Mad-Sin3 complex: implications for recruitment of a chromatin-modifying complex. Cell. Nov. 10, 2000;103(4):655-65.

Brusselle, et al. Allergen-induced airway inflammation and bronchial responsiveness in wild-type and interleukin-4-deficient mice. Am J Respir Cell Mol Biol. Mar. 1995;12(3):254-9.

Burger, et al. Synthesis of a-(trifluoromethyl)-substituted a-amino acids. Part 7. An efficient synthesis for a-trifluoromethyl-substituted w-carboxy a-amino acids. Chemiker-Zeitung. 1990;114(3):101-04. German.

Cabezas & Satterthwait, "The Hydrogen Bond Mimic Approach: Solid-phase Synthesis of a Peptide Stabilized as an α-Helix with a Hydrazone Link," J. Am. Chem. Soc. 121:3862-3875 (1999).

Caricasole, et al. The Wnt pathway, cell-cycle activation and beta-amyloid: novel therapeutic strategies in Alzheimer's disease? Trends Pharmacol Sci. May 2003;24(5):233-8.

Carillo et al., The Multiple Sequence Alignment Problem in Biology. SIAM J Applied Math. 1988;48:1073-82.

Carlson et al., Specificity landscapes of DNA binding molecules elucidate biological function. Proc Natl Acad Sci USA. Mar. 9, 2010;107(10):4544-9. doi: 10.1073/pnas.0914023107. Epub Feb. 22, 2010.

Chakrabartty et al., "Helix Capping Propensities in Peptides Parallel Those in Proteins," Proc. Nat'l Acad. Sci. USA 90:11332-11336 (1993).

Chapman et al., "A Highly Stable Short α-Helix Constrained by a Main-chain Hydrogen-bond Surrogate," J. Am. Chem. Soc. 126:12252-12253 (2004).

Chapman, et al. Optimized synthesis of hydrogen-bond surrogate helices: surprising effects of microwave heating on the activity of Grubbs catalysts. Org Lett. Dec. 7, 2006;8(25):5825-8.

Chen et al., Determination of the helix and beta form of proteins in aqueous solution by circular dichroism. Biochemistry. Jul. 30, 1974;13(16):3350-9.

Chen, et al. Small molecule-mediated disruption of Wnt-dependent signaling in tissue regeneration and cancer.. Nat Chem Biol. Feb. 2009;5(2):100-7. Epub Jan. 4, 2009.

Cheng et al., Emerging role of RAB GTPases in cancer and human disease. Cancer Res. Apr. 1, 2005;65(7):2516-9.

Cheng et al., The RAB25 small GTPase determines aggressiveness of ovarian and breast cancers. Nat Med. Nov. 2004;10(11):1251-6. Epub Oct. 24, 2004.

Cheon, et al. Beta-Catenin stabilization dysregulates mesenchymal cell proliferation, motility, and invasiveness and causes aggressive fibromatosis and hyperplastic cutaneous wounds. Proc Natl Acad Sci U S A. May 14, 2002;99(10):6973-8. Epub Apr. 30, 2002.

Chia et al., Emerging roles for Rab family GTPases in human cancer. Biochim Biophys Acta. Apr. 2009;1795(2):110-6.

Chiaramonte, et al. Studies of murine schistosomiasis reveal interleukin-13 blockade as a treatment for established and progressive liver fibrosis. Hepatology. Aug. 2001;34(2):273-82.

Chin & Schepartz, "Design and Evolution of a Miniature Bcl-2 Binding Protein," Angew. Chem. Int. Ed. 40(20):3806-3809 (2001).

Chin et al., "Circular Dichroism Spectra of Short, Fixed-nucleus Alanine Helices," Proc. Nat'l Acad. Sci. USA 99(24):15416-15421 (2002).

Chittenden, et al. A conserved domain in Bak, distinct from BH1 and BH2, mediates cell death and protein binding functions. EMBO J. Nov. 15, 1995;14(22):5589-96.

Christodoulides, et al. WNT10B mutations in human obesity. Diabetologia. Apr. 2006;49(4):678-84. Epub Feb. 14, 2006.

Clark, et al. Supramolecular Design by Covalent Capture. Design of a Peptide Cylinder via Hydrogen-Bond-Promoted Intermolecular Olefin Metathesis. J Am Chem Soc. 1995;117:12364-65.

Cleary, et al. Nucleotide sequence of a t(14;18) chromosomal breakpoint in follicular lymphoma and demonstration of a breakpoint-cluster region near a transcriptionally active locus on chromosome 18. Proc Natl Acad Sci U S A. Nov. 1985;82(21):7439-43.

Clevers. Wnt/beta-catenin signaling in development and disease. Cell. Nov. 3, 2006;127(3):469-80.

Cohn, et al. IL-4-independent induction of airway hyperresponsiveness by Th2, but not Th1, cells. J Immunol. Oct. 15, 1998;161(8):3813-6.

Cole, et al. Transcription-independent functions of MYC: regulation of translation and DNA replication. Nat Rev Mol Cell Biol. Oct. 2008;9(10):810-5.

Cong, et al. A protein knockdown strategy to study the function of beta-catenin in tumorigenesis. BMC Mol Biol. Sep. 29, 2003;4:10.

Cossu, et al. Wnt signaling and the activation of myogenesis in mammals. EMBO J. Dec. 15, 1999;18(24):6867-72.

Cusack, et al. 2,4,6-Tri-isopropylbenzenesulphonyl Hydrazide: A Convenient Source of Di-imide. Tetrahedron. 1976;32:2157-62.

Danial, et al. Cell death: critical control points. Cell. 2004; 116:204-219.

Dawson, et al. Synthesis of proteins by native chemical ligation. Science. Nov. 4, 1994;266(5186):776-9.

De Guzman, et al. Structural basis for cooperative transcription factor binding to the CBP coactivator. J Mol Biol. Feb. 3, 2006;355(5):1005-13.

De Meyts et al., Insulin interactions with its receptors: experimental evidence for negative cooperativity. Biochem Biophys Res Commun. Nov. 1, 1973;55(1):154-61.

De Meyts, The structural basis of insulin and insulin-like growth factor-I receptor binding and negative co-operativity, and its relevance to mitogenic versus metabolic signalling. Diabetologia. Sep. 1994;37 Suppl 2:S135-48.

Debinski, et al. Retargeting interleukin 13 for radioimmunodetection and radioimmunotherapy of human high-grade gliomas. Clin Cancer Res. Oct. 1999;S(10 Suppl):3143s-3147s.

Degterev et al., "Identification of Small-molecule Inhibitors of Interaction between the BH3 Domain and Bcl-xL," Nature Cell Biol. 3:173-182 (2001).

Denmark, et al. Cyclopropanation with Diazomethane and Bis(oxazoline)palladium(II) Complexes. J Org Chem. May 16, 1997;62(10):3375-3389.

Designing Custom Peptide. from SIGMA Genosys, pp. 1-2. Accessed Dec. 16, 2004.

Devereux et al., A comprehensive set of sequence analysis programs for the VAX. Nucleic Acids Res. Jan. 11, 1984;12(1 Pt 1):387-95.

Dimartino, et al. Solid-phase synthesis of hydrogen-bond surrogate-derived alpha-helices. Org Lett. Jun. 9, 2005;7(12):2389-92.

Doron, et al. Probiotics: their role in the treatment and prevention of disease. Expert Rev Anti Infect Ther. Apr. 2006;4(2):261-75.

Eisenmesser, et al. Solution structure of interleukin-13 and insights into receptor engagement. J Mol Biol. Jun. 29, 2001;310(1):231-41.

Ellis, et al. Design, synthesis, and evaluation of a new generation of modular nucleophilic glycine equivalents for the efficient synthesis of sterically constrained alpha-amino acids. J Org Chem. Oct. 27, 2006;71(22):8572-8.

Erlanson, et al. The leucine zipper domain controls the orientation of AP-1 in the NFAT.AP-1.DNA complex. Chem Biol. Dec. 1996;3(12):981-91.

European office action dated Aug. 20, 2012 for EP Application No. 09730445.5.

European search report and opinion dated Jul. 20, 2012 for EP Application No. 12159110.1.

European search report and opinion dated Sep. 27, 2012 for EP Application No. 12159110.1.

European search report and search opinion dated May 6, 2011 for Application No. 10195495.6.

European search report and search opinion dated May 9, 2011 for Application No. 10195490.7.

(56) References Cited

OTHER PUBLICATIONS

European search report dated Nov. 7, 2008 for Application No. 8016651.5.
European search report dated Aug. 22, 2008 for Application No. 4811198.3.
Evans et al., The Rise of Azide—Alkyne 1,3-Dipolar 'Click' Cycloaddition and its Application to Polymer Science and Surface Modification. Australian Journal of Chemistry. 2007;60:384-95.
Favrin, et al. Two-state folding over a weak free-energy barrier. Biophys J. Sep. 2003;85(3):1457-65.
Felix et al., "Synthesis, Biological Activity and Conformational Analysis of Cyclic GRF Analogs," Int. J. Pep. Protein Res. 32:441-454 (1988).
Fischback, et al. Specific biochemical inactivation of oncogenic Ras proteins by nucleoside diphosphate kinase. Cancer Res. Jul. 15, 2003;63(14):4089-94.
Fischer, et al. Apoptosis-based therapies and drug targets. Cell Death and Differentiation. 2005; 12:942-961.
Fischer, et al. The HIV-1 Rev activation domain is a nuclear export signal that accesses an export pathway used by specific cellular RNAs. Cell. Aug. 11, 1995;82(3):475-83.
Fisher et al., Myc/Max and other helix-loop-helix/leucine zipper proteins bend DNA toward the minor groove. Proc Natl Acad Sci U S A. Dec. 15, 1992;89(24):11779-83.
Formaggio, et al. Inversion of 3(10)-helix screw sense in a (D-alpha Me)Leu homo-tetrapeptide induced by a guest D-(alpha Me)Val residue. J Pept Sci. Nov./Dec. 1995;1(6):396-402.
Fromme, et al. Structural basis for removal of adenine mispaired with 8-oxoguanine by MutY adenine DNA glycosylase. Nature. Feb. 12, 2004;427(6975):652-6.
Fuchs, et al. Socializing with the neighbors: stem cells and their niche. Cell. Mar. 19, 2004;116(6):769-78.
Fulda, et al. Extrinsic versus intrinsic apoptosis pathways in anticancer chemotherapy. Oncogene. Aug. 7, 2006;25(34):4798-811.
Furstner, et al. Alkyne metathesis: development of a novel molybdenum-based catalyst system and its application to the total synthesis of epothilone A and C. Chemistry. Dec. 17, 2001;7(24):5299-317.
Furstner, et al. Mo[N(t-Bu)(AR)]3 Complexes as catalyst precursors: In situ activation and application to metathesis reactions of alkynes and diynes. J Am chem Soc. 1999; 121:9453-54.
Furstner, et al. Nozaki—Hiyama—Kishi reactions catalytic in chromium. J Am Chem Soc. 1996; 118:12349-57.
Gallivan, et al. A neutral, water-soluble olefin metathesis catalyst based on an N-heterocyclic carbene ligand. Tetrahedron Letters. 2005; 46:2577-80.
Galluzzi, et al. Guidelines for the use and interpretation of assays for monitoring cell death in higher eukaryotes. Cell Death Differ. Aug. 2009;16(8):1093-107. Epub Apr. 17, 2009.
Gante. Peptidomimetics—Tailored enzyme inhibitors. J Angew Chem Int Ed Engl. 1994; 33:1699-1720.
Gat, et al. De Novo hair follicle morphogenesis and hair tumors in mice expressing a truncated beta-catenin in skin. Cell. Nov. 25, 1998;95(5):605-14.
Gavathiotis, et al. BAX activation is initiated at a novel interaction site. Nature. Oct. 23, 2008;455(7216):1076-81.
Gerber-Lemaire, et al. Glycosylation pathways as drug targets for cancer: glycosidase inhibitors. Mini Rev Med Chem. Sep. 2006;6(9):1043-52.
Ghadiri & Choi, "Secondary Structure Nucleation in Peptides. Transition Metal Ion Stabilized α-Helices," J. Am. Chem. Soc. 112:1630-1632 (1990).
Giannis, et al. Peptidomimetics for receptor ligands—Discovery, development, and medical perspectives. Angew Chem Int Ed Engl. 1993; 32:1244-67.
Gong, et al. LDL receptor-related protein 5 (LRP5) affects bone accrual and eye development. Cell. Nov. 16, 2001;107(4):513-23.
Goodson, et al. Potential Growth Antagonists. I. Hydantoins and Disubstituted Glycines. J Org Chem. 1960;25:1920-24.
Gorlich, et al. Transport between the cell nucleus and the cytoplasm. Annu Rev Cell Dev Biol. 1999; 15:607-60.
Goun, et al. Molecular transporters: synthesis of oligoguanidinium transporters and their application to drug delivery and real-time imaging. Chembiochem. Oct. 2006;7(10):1497-515.
Greenfield, et al. Computed circular dichroism spectra for the evaluation of protein conformation. Biochemistry. Oct. 1969;8(10):4108-16.
Greenlee et al., A General Synthesis of a-vinyl-a-amino acids. Tetrahedron Letters. 1978;42:3999-4002.
Grunig, et al.Requirement for IL-13 independently of IL-4 in experimental asthma. Science. Dec. 18, 1998;282(5397):2261-3.
Guinn, et al. Synthesis and characterization of polyamides containing unnatural amino acids. Biopolymers. May 1995;35(5):503-12.
Harper, et al.Efficacy of a bivalent L1 virus-like particle vaccine in prevention of infection with human papillomavirus types 16 and 18 in young women: a randomised controlled trial. Lancet. Nov. 13-19, 2004;364(9447):1757-65.
Harris et al., Synthesis of proline-modified analogues of the neuroprotective agent glycyl-lprolyl-glutamic acid (GPE). Tetrahedron. 2005;61:10018-35.
Hartmann, et al. Dual roles of Wnt signaling during chondrogenesis in the chicken limb. Development. Jul. 2000;127(14):3141-59.
Hartmann. A Wnt canon orchestrating osteoblastogenesis. Trends Cell Biol. Mar. 2006;16(3):151-8. Epub Feb. 7, 2006.
Hellman et al., Electrophoretic mobility shift assay (EMSA) for detecting protein-nucleic acid interactions. Nat Protoc. 2007;2(8):1849-61.
Henchey, et al. Contemporary strategies for the stabilization of peptides in the a-helical conformation. Curr Opin Chem Biol. 2008;12:692-97.
Hipfner, et al. Connecting proliferation and apoptosis in development and disease. Nat Rev Mol Cell Biol. Oct. 2004;5(10):805-15.
Hiroshige, et al. Palladium-mediated macrocyclisations on solid support and its applica—tions to combinatorial synthesis. J. Am. Chem. Soc. 1995; 117:11590-11591.
Hoang, et al. Dickkopf 3 inhibits invasion and motility of Saos-2 osteosarcoma cells by modulating the Wnt-beta-catenin pathway. Cancer Res. Apr. 15, 2004;64(8):2734-9.
Holford, et al. Adding 'splice' to protein engineering. Structure. Aug. 15, 1998;6(8):951-6.
Hoveyda et al., "Ru Complexes Bearing Bidentate Carbenes: From Innocent Curiosity to Uniquely Effective Catalysts for Olefin Metathesis," Org. Biomolec. Chem. 2:8-23 (2004).
Hu, et al. Efficient p53 activation and apoptosis by simultaneous disruption of binding to MDM2 and MDMX. Cancer Res. Sep. 15, 2007;67(18):8810-7.
Huang et al., How insulin binds: the B-chain alpha-helix contacts the L1 beta-helix of the insulin receptor. J Mol Biol. Aug. 6, 2004;341(2):529-50.
Huang, et al. Tankyrase inhibition stabilizes axin and antagonizes Wnt signalling. Nature. Oct. 1, 2009;461(7264):614-20. Epub Sep. 16, 2009.
International preliminary report on patentability dated Feb. 3, 2011 for PCT/US2009/004260.
International preliminary report on patentability dated Oct. 8, 2009 for PCT/US2008/058575.
International Preliminary Report on Patentability for PCT/US2010/001952, Jan. 26, 2012.
International search report and written opinion dated Nov. 17, 2008 for PCT/US2008/058575.
International search report and written opinion dated Feb. 2, 2011 for PCT/US2010/001952.
International search report and written opinion dated May 16, 2008 for PCT/US2008/052580.
International search report and written opinion dated Oct. 12, 2011 for PCT/US2011/047692.
International search report and written opinion dated Oct. 15, 2010 for PCT/US2009/004260.
International Search Report and Written Opinion for PCT/US2011/052755, mailed Apr. 25, 2012.
International Search Report and Written Opinion for PCT/US2012/042738, mailed Oct. 18, 2012.
International search report and written report dated May 29, 2013 for PCT/US2013/026238.

(56) References Cited

OTHER PUBLICATIONS

International search report dated Nov. 30, 2009 for PCT Application No. US2009/02225.
International search report dated May 18, 2005 for PCT Application No. US2004/38403.
Invitation to pay additional fees dated Mar. 19, 2010 for PCT/US2010/004260.
Invitation to pay additional fees dated Oct. 29, 2010 for PCT/US2010/001952.
Invitation to Pay Additional Fees for PCT/US2011/052755 mailed Feb. 16, 2012.
Jackson, et al. General Approach to the Synthesis of Short a-Helical Peptides. J Am Chem Soc. 1991;113:9391-93.
Jamieson, et al. Granulocyte-macrophage progenitors as candidate leukemic stem cells in blast-crisis CML. N Engl J Med. Aug. 12, 2004;351(7):657-67.
Jensen et al., Activation of the insulin receptor (IR) by insulin and a synthetic peptide has different effects on gene expression in IR-transfected L6 myoblasts. Biochem J. Jun. 15, 2008;412(3):435-45. doi: 10.1042/BJ20080279.
Jordan, et al. Wnt4 overexpression disrupts normal testicular vasculature and inhibits testosterone synthesis by repressing steroidogenic factor 1/beta-catenin synergy. Proc Natl Acad Sci U S A. Sep. 16, 2003;100(19):10866-71. Epub Aug. 29, 2003.
Junutula et al., Molecular characterization of Rab1 interactions with members of the family of Rab1-interacting proteins. J Biol Chem. Aug. 6, 2004;279(32):33430-7. Epub Jun. 1, 2004.
Karle, et al. Structural charateristics of alpha-helical peptide molecules containing Aib residues. Biochemistry. Jul. 24, 1990;29(29):6747-56.
Karle. Flexibility in peptide molecules and restraints imposed by hydrogen bonds, the Aib residue, and core inserts. Biopolymers. 1996;40(1):157-80.
Karwoski, et al. Lysinonorleucine cross-link formation in alpha amino heptenoic acid-substituted peptide derivatives. Biopolymers. 1978;17(5):1119-27.
Katoh, et al. Cross-talk of WNT and FGF signaling pathways at GSK3beta to regulate beta-catenin and SNAIL signaling cascades. Cancer Biol Ther. Sep. 2006;5(9):1059-64. Epub Sep. 4, 2006.
Katsu, et al. The human frizzled-3 (FZD3) gene on chromosome 8p21, a receptor gene for Wnt ligands, is associated with the susceptibility to schizophrenia. Neurosci Lett. Dec. 15, 2003;353(1):53-6.
Kaul, et al. Stereochemical control of peptide folding. Bioorg Med Chem. Jan. 1999;7(1):105-17.
Kawamoto, Targeting the BCL9/B9L binding interaction with beta-catenin as a potential anticancer strategy. PhD Thesis. Jun. 3, 2010. Available at http://deepblue.lib.umich.edu/handle/2027.42/758461ast accessed Apr. 9, 2012. Abstract only. 2 pages.
Kazmaier, Sythesis of Quaternary Amino Acids Containing 3, y—as well as 7,6-Unsaturated Side Chains via Chelate-Enolate Claisen Rearrangement. Tetrahedron Letters. 1996;37(30):5351-4.
Kelly-Welch, et al. Interleukin-4 and interleukin-13 signaling connections maps. Science. Jun. 6, 2003;300(5625):1527-8.
Kelso et al., "A Cyclic Metallopeptide Induces α Helicity in Short Peptide Fragments of Thermolysin," Angew. Chem. Int. Ed. 42(4):421-424 (2003).
Kelso et al., "α-Turn Mimetics: Short Peptide α-Helices Composed of Cyclic Metallopentapeptide Modules," J. Am. Chem. Soc. 126:4828-4842 (2004).
Kemp et al., "Studies of N-Terminal Templates for α-Helix Formation. Synthesis and Conformational Analysis of (2S,5S,8S,11S)-1-Acetyl-1,4-diaza-3-keto-5-carboxy-10-thiatricyclo[2.8.1.04,8]-tridecane (Ac-Hell-OH)," J. Org. Chem. 56:6672-6682 (1991).
Kent. Advanced Biology. Oxford University Press. 2000.
Kilby et al., "Potent Suppression of HIV-1 Replication in Humans by T-20, a Peptide Inhibitor of gp41-Mediated Virus Entry," Nat. Med. 4(11):1302-1307 (1998).
Kim et al., Synthesis of all-hydrocarbon stapled a-helical peptides by ring-closing olefin metathesis. Nat Protoc. Jun. 2011;6(6):761-71. doi: 10.1038/nprot.2011.324. Epub May 12, 2011.
Kim, et al. Stereochemical effects of all-hydrocarbon tethers in i,i+4 stapled peptides. Bioorg Med Chem Lett. May 1, 2009;19(9):2533-6.
Kimmerlin, et al. '100 years of peptide synthesis': ligation methods for peptide and protein synthesis with applications to beta-peptide assemblies. J Pept Res. Feb. 2005;65(2):229-60.
Kinzler, et al. Identification of FAP locus genes from chromosome 5q21. Science. Aug. 9, 1991;253(5020):661-5.
Kinzler, et al. Lessons from hereditary colorectal cancer. Cell. Oct. 18, 1996;87(2):159-70.
Knackmuss, et al. Specific inhibition of interleukin-13 activity by a recombinant human single-chain immunoglobulin domain directed against the IL-13 receptor alphal chain. Biol Chem. Mar. 2007;388(3):325-30.
Kohler et al., DNA specificity enhanced by sequential binding of protein monomers. Proc Natl Acad Sci U S A. Oct. 12, 1999;96(21):11735-9.
Kolb et al., Click Chemistry: Diverse Chemical Function from a Few Good Reactions. Angew Chem Int Ed Engl. Jun. 1, 2001;40(11):2004-2021.
Kondo, et al. Frizzled 4 gene (FZD4) mutations in patients with familial exudative vitreoretinopathy with variable expressivity. Br J Ophthalmol. Oct. 2003;87(10):1291-5.
Korcsmaros, et al. Uniformly curated signaling pathways reveal tissue-specific cross-talks and support drug target discovery. Bioinformatics. Aug. 15, 2010;26(16):2042-50. Epub Jun. 11, 2010.
Korinek, et al. Depletion of epithelial stem-cell compartments in the small intestine of mice lacking Tcf-4. Nat Genet. Aug. 1998;19(4):379-83.
Kotha, et al. Modification of constrained peptides by ring-closing metathesis reaction. Bioorg Med Chem Lett. Jun. 4, 2001;11(11):1421-3.
Kouzarides, et al. Acetylation: a regulatory modification to rival phosphorylation? EMBO J. Mar. 15, 2000;19(6):1176-9.
Kozlovsky, et al. GSK-3 and the neurodevelopmental hypothesis of schizophrenia. Eur Neuropsychopharmacol. Feb. 2002;12(1):13-25.
Kristensen et al., Expression and characterization of a 70-kDa fragment of the insulin receptor that binds insulin. Minimizing ligand binding domain of the insulin receptor. J Biol Chem. Jul. 10, 1998;273(28):17780-6.
Kristensen et al., Functional reconstitution of insulin receptor binding site from non-binding receptor fragments. J Biol Chem. May 24, 2002;277(21):18340-5. Epub Mar. 18, 2002.
Kritzer et al., "Helical β-Peptide Inhibitors of the p53—hDM2 Interaction," J. Am. Chem. Soc. 126:9468-9469 (2004).
Kurose et al., Cross-linking of a B25 azidophenylalanine insulin derivative to the carboxyl-terminal region of the alpha-subunit of the insulin receptor. Identification of a new insulin-binding domain in the insulin receptor. J Biol Chem. Nov. 18, 1994;269(46):29190-7.
Kussie, et al. Structure of the MDM2 oncoprotein bound to the p53 tumor suppressor transactivation domain. Science. Nov. 8, 1996;274(5289):948-53.
Kutchukian, et al. All-atom model for stabilization of alpha-helical structure in peptides by hydrocarbon staples. J Am Chem Soc. Apr. 8, 2009;131(13):4622-7.
Kutzki et al., "Development of a Potent Bcl-xL Antagonist Based on α-Helix Mimicry," J. Am. Chem. Soc. 124:11838-11839 (2002).
Kwon, et al. Quantitative comparison of the relative cell permeability of cyclic and linear peptides. Chem Biol. Jun. 2007;14(6):671-7.
Lacombe, et al. Reduction of Olefms on Solid Support Using Diimide. Tetranderon Lett. 1998;39:6785-86.
Lammi, et al. Mutations in AXIN2 cause familial tooth agenesis and predispose to colorectal cancer. Am J Hum Genet. May 2004;74(5):1043-50. Epub Mar. 23, 2004.
Laporte, et al. Molecular and structural basis of cytokine receptor pleiotropy in the interleukin-4/13 system. Cell. Jan. 25, 2008;132(2):259-72.
Le Geuzennec, et al. Molecular characterization of Sin3 PAH-domain interactor specificity and identification of PAH partners. Nucleic Acids Res. 2006;34(14):3929-37. Epub Aug. 12, 2006.
Le Geuzennec, et al. Molecular determinants of the interaction of Mad with the PAH2 domain of mSin3. J Biol Chem. Jun. 11, 2004;279(24):25823-9.

(56) References Cited

OTHER PUBLICATIONS

Leduc, et al. Helix-stabilized cyclic peptides as selective inhibitors of steroid receptor-coactivator interactions. Proc Natl Acad Sci U S A. Sep. 30, 2003;100(20):11273-8.

Lee, et al. A novel BH3 ligand that selectively targets Mcl-1 reveals that apoptosis can proceed without Mcl-1 degradation. J Cell Biol. Jan. 28, 2008;180(2):341-355.

Liang, et al. Wnt5a inhibits B cell proliferation and functions as a tumor suppressor in hematopoietic tissue. Cancer Cell. Nov. 2003;4(5):349-60.

Liskamp, et al. Conformationally restricted amino acids and dipeptides, (non)peptidomimetics and secondary structure mimetics. Recl Travl Chim Pays-Bas. 1994; 113:1-19.

Litowski & Hodges, "Designing Heterodimeric Two-stranded α-Helical Coiled-coils: Effects of Hydrophobicity and α-Helical Propensity on Protein Folding, Stability, and Specificity," J. Biol. Chem. 277(40):37272-37279 (2002).

Little, et al. A Mutation in the LDL Receptor-Related Protein 5 Gene Results in the Autosomal Dominant High-Bone-Mass Trait. Am J Hum Genet. 2002;70:11-19.

Liu, et al. Chemical ligation approach to form a peptide bond between unprotected peptide segments. Concept and model study. J Am Chem Soc. 1994; 116(10):4149-53.

Liu, et al. Targeted degradation of beta-catenin by chimeric F-box fusion proteins. Biochem Biophys Res Commun. Jan. 23, 2004;313(4):1023-9.

Lo, et al. Phosphorylation by the beta-catenin/MAPK complex promotes 14-3-3-mediated nuclear export of TCF/POP-1 in signal-responsive cells in *C. elegans*. Cell. Apr. 2, 2004;117(1):95-106.

Logan, et al. The Wnt signaling pathway in development and disease. Annu Rev Cell Dev Biol. 2004;20:781-810.

Losey, et al. Crystal structure of *Staphylococcus aureus* tRNA adenosine deaminase TadA in complex with RNA. Nat Struct Mol Biol. Feb. 2006;13(2):153-9.

Lou et al., The first three domains of the insulin receptor differ structurally from the insulin-like growth factor 1 receptor in the regions governing ligand specificity. Proc Natl Acad Sci U S A. Aug. 15, 2006;103(33):12429-34. Epub Aug. 7, 2006.

Loughlin, et al. Functional variants within the secreted frizzled-related protein 3 gene are associated with hip osteoarthritis in females. Proc Natl Acad Sci U S A. Jun. 29, 2004;101(26):9757-62. Epub Jun. 21, 2004.

Luo, et al. Mechanism of helix induction by trifluoroethanol: a framework for extrapolating the helix-forming properties of peptides from trifluoroethanol/water mixtures back to water. Biochemistry. Jul. 8, 1997;36(27):8413-21.

Luo, et al. Wnt signaling and hunian diseases: what are the therapeutic implications? Lab Invest. Feb. 2007;87(2):97-103. Epub Jan. 8, 2007.

Luscher et al., The basic region/helix-loop-helix/leucine zipper domain of Myc protooncoproteins: function and regulation. Oncogene. May 13, 1999;18(19):2955-66.

Luu, et al. Wnt/beta-catenin signaling pathway as a novel cancer drug target. Curr Cancer Drug Targets. Dec. 2004;4(8):653-71.

Lyu & Wemmer, "Capping Interactions in Isolated α Helices: Position-dependent Substitution Effects and Structure of a Serine-capped Peptide Helix," Biochemistry 32:421-425 (1993).

Lyu et al, "α-Helix Stabilization by Natural and Unnatural Amino Acids with Alkyl Side Chains," Proc. Nat'l Acad. Sci. USA 88:5317-5320 (1991).

MacMillan. Evolving strategies for protein synthesis converge on native chemical ligation. Angew Chem Int Ed Engl. Nov. 27, 2006;45(46):7668-72.

Mai et al. A proapoptotic peptide for the treatment of solid tumors Cancer Res. Nov. 1, 2001;61(21):7709-12.

Marshall et al., Back to the future: ribonuclease A. Biopolymers. 2008;90(3):259-77.

McGahon, et al. The end of the (cell) line: methods for the study of apoptosis in vitro. Methods Cell Biol. 1995;46:153-85.

McKern et al., Structure of the insulin receptor ectodomain reveals a folded-over conformation. Nature. Sep. 14, 2006;443(7108):218-21. Epub Sep. 6, 2006.

McNamara et al., Peptides constrained by an aliphatic linkage between two C(alpha) sites: design, synthesis, and unexpected conformational properties of an i,(i + 4)-linked peptide. J Org Chem. Jun. 29, 2001;66(13):4585-94.

Menting et al., A thermodynamic study of ligand binding to the first three domains of the human insulin receptor: relationship between the receptor alpha-chain C-terminal peptide and the site 1 insulin mimetic peptides. Biochemistry. Jun. 16, 2009;48(23):5492-500. doi: 10.1021/bi900261q.

Meyers et al., Formation of mutually exclusive Rab11 complexes with members of the family of Rab11-interacting proteins regulates Rab11 endocytic targeting and function. J Biol Chem. Dec. 13, 2002;277(50):49003-10. Epub Oct. 9, 2002.

Miloux, et al. Cloning of the human IL-13R alpha1 chain and reconstitution with the IL4R alpha of a functional IL-4/IL-13 receptor complex. FEBS Lett. Jan. 20, 1997;401(2-3):163-6.

Miyaoka, et al. Increased expression of Wnt-1 in schizophrenic brains. Schizophr Res. Jul. 27, 1999;38(1):1-6.

Moellering, et al. Direct inhibition of the NOTCH transcription factor complex. Nature. Nov. 12, 2009;462(7270):182-8.

Moon, et al. WNT and beta-catenin signalling: diseases and therapies. Nat Rev Genet. Sep. 2004;5(9):689-699.

Morin. beta-catenin signaling and cancer. Bioessays. Dec. 1999;21(12):1021-30.

Moy, et al. Solution structure of human IL-13 and implication for receptor binding. J Mol Biol. Jun. 29, 2001;310(1):219-30.

Muchmore, et al. X-ray and NMR structure of human Bcl-xL, an inhibitor of programmed cell death. Nature. May 23, 1996;381(6580):335-41.

Mudher, et al. Alzheimer's disease—do tauists and baptists finally shake hands? Trends Neurosci. Jan. 2002;25(1):22-6.

Muir, et al. Expressed protein ligation: a general method for protein engineering. Proc Natl Acad Sci U S A. Jun. 9, 1998;95(12):6705-10.

Muir. Semisynthesis of proteins by expressed protein ligation. Annu Rev Biochem. 2003;72:249-89.

Mynarcik et al., Alanine-scanning mutagenesis of a C-terminal ligand binding domain of the insulin receptor alpha subunit. J Biol Chem. Feb. 2, 1996;271(5):2439-42.

Mynarcik et al., Identification of common ligand binding determinants of the insulin and insulin-like growth factor 1 receptors. Insights into mechanisms of ligand binding. J Biol Chem. Jul. 25, 1997;272(30):18650-5.

Myung, et al. The ubiquitin-proteasome pathway and proteasome inhibitors. Med Res Rev. Jul. 2001;21(4):245-73.

Nair, et al. X-ray structures of Myc-Max and Mad-Max recognizing DNA. Molecular bases of regulation by proto-oncogenic transcription factors. Cell. Jan. 24, 2003; 112(2):193-205.

Nakashima, et al. Cross-talk between Wnt and bone morphogenetic protein 2 (BMP-2) signaling in differentiation pathway of C2C12 myoblasts. J Biol Chem. Nov. 11, 2005;280(45):37660-8. Epub Sep. 2, 2005.

Nelson & Kallenbach, "Persistence of the α-Helix Stop Signal in the S-Peptide in Trifluoroethanol Solutions," Biochemistry 28:5256-5261 (1989).

Ngo et al., Computational complexity, protein structure prediction, and the levinthal paradox. In: The Protein Folding Problem and Tertiary Structure Prediction. K. Mem, Jr., et al. Eds. 1994:433506.

Niemann, et al. Homozygous WNT3 mutation causes tetra-amelia in a large consanguineous family. Am J Hum Genet. Mar. 2004;74(3):558-63. Epub Feb. 5, 2004.

Nilsson, et al. Staudinger ligation: a peptide from a thioester and azide. Org Lett. Jun. 29, 2000;2(13):1939-41.

Nishisho, et al. Mutations of chromosome 5q21 genes in FAP and colorectal cancer patients. Science. Aug. 9, 1991;253(5020):665-9.

Node, et al. Hard acid and soft nucleophile systems. 3. Dealkylation of esters with aluminum halide-thiol and aluminum halide-sulfide stustems. J Org Chem. 1981; 46:1991-93.

Non-Final Office Action dated Dec. 5, 2008 from U.S. Appl. No. 10/981,873.

(56) References Cited

OTHER PUBLICATIONS

Notice of Allowance, mailed Aug. 6, 2012, in U.S. Appl. No. 12/796,212.
O'Neil & DeGrado, "A Thermodynamic Scale for the Helix-forming Tendencies of the Commonly Occurring Amino Acids," Science 250:646-651(1990).
Office action dated Jan. 3, 2013 for U.S. Appl. No. 12/593,384.
Office action dated Jan. 26, 2009 for U.S. Appl. No. 11/148,976.
Office Action dated Jan. 30, 2008 for U.S. Appl. No. 10/981,873.
Office action dated Feb. 9, 2012 for U.S. Appl. No. 12/420,816.
Office action dated Feb. 17, 2011 for U.S. Appl. No. 12/796,212.
Office action dated Mar. 22, 2013 for U.S. Appl. No. 12/233,555.
Office action dated Apr. 18, 2011 for U.S. Appl. No. 12/182,673.
Office action dated Jun. 28, 2012 for U.S. Appl. No. 12/233,555.
Office action dated Jul. 15, 2013 for U.S. Appl. No. 13/570,146.
Office action dated Aug. 9, 2010 for U.S. Appl. No. 12/182,673.
Office action dated Oct. 18, 2011 for U.S. Appl. No. 12/796,212.
Office action dated Nov. 5, 2002 for U.S. Appl. No. 09/574,086.
Office action dated Nov. 25, 2009 for U.S. Appl. No. 11/148,976.
Office action dated Dec. 29, 2011 for U.S. Appl. No. 12/233,555.
Office Communication, mailed Feb. 9, 2012, for U.S. Appl. No. 12/420,816.
Office Communication, mailed Oct. 18, 2011, for U.S. Appl. No. 12/796,212.
Okamura, et al. Redundant regulation of T cell differentiation and TCRalpha gene expression by the transcription factors LEF-1 and TCF-1. Immunity. Jan. 1998;8(1):11-20.
Olson, et al. Sizing up the heart: development redux in disease. Genes Dev. Aug. 15, 2003;17(16):1937-56. Epub Jul. 31, 2003.
Ösapay & Taylor, "Multicyclic Polypeptide Model Compounds. 2. Synthesis and Conformational Properties of a Highly α-Helical Uncosapeptide Constrained by Three Side-chain to Side-chain Lactam Bridges," J. Am. Chem. Soc. 114:6966-6973 (1992).
Pakotiprapha, et al. Crystal structure of *Bacillus stearothermophilus* UvrA provides insight into ATP-modulated dimerization, UvrB interaction, and DNA binding. Mol Cell. Jan. 18, 2008;29(1):122-33.
Pazgier, et al. Structural basis for high-affinity peptide inhibition of p53 interactions with MDM2 and MDMX. Proc Natl Acad Sci U S A. Mar. 24, 2009;106(12):4665-70. doi: 10.1073/pnas.0900947106. Epub Mar. 2, 2009.
Perantoni. Renal development: perspectives on a Wnt-dependent process. Semin Cell Dev Biol. Aug. 2003;14(4):201-8.
Phelan, et al. A general method for constraining short peptides to an alpha-helical conformation. J Am Chem Soc. 1997; 119(3):455-60.
Phelan, et al. A General Method for Constraining Short Peptides to an α-Helical Conformation. J. Am. Chem. Soc. 1997;119:455-460.
Picksley, et al. Immunochemical analysis of the interaction of p53 with MDM2;—fine mapping of the MDM2 binding site on p53 using synthetic peptides. Oncogene. Sep. 1994;9(9):2523-9.
Pillutla et al., Peptides identify the critical hotspots involved in the biological activation of the insulin receptor. J Biol Chem. Jun. 21, 2002;277(25):22590-4. Epub Apr. 18, 2002.
Polakis. The oncogenic activation of beta-catenin. Curr Opin Genet Dev. Feb. 1999;9(1):15-21.
Qiu, et al. Convenient, large-scale asymmetric synthesis of enantiomerically pure trans-cinnamylglycine and -alpha-alanine. Tetrahedron. 2000; 56:2577-82.
Rawlinson, et al. CRM1-mediated nuclear export of dengue virus RNA polymerase NS5 modulates interleukin-8 induction and virus production. J Biol Chem. Jun. 5, 2009;284(23):15589-97.
Reya, et al. Wnt signalling in stem cells and cancer. Nature. Apr. 14, 2005;434(7035):843-50.
Rich, et al. Synthesis of the cytostatic cyclic tetrapeptide, chlamydocin. Tetranderon Letts. 1983;24(48):5305-08.
Roberts, et al. Efficient synthesis of thioether-based cyclic peptide libraries. Tetrahedon Letters. 1998; 39: 8357-8360.
Roberts, et al. Examination of methodology for the synthesis of cyclic thioether peptide libraries derived from linear tripeptides. J Pept Sci. Dec. 2007;13(12):811-21.
Robitaille, et al. Mutant frizzled-4 disrupts retinal angiogenesis in familial exudative vitreoretinopathy. Nat Genet. Oct. 2002;32(2):326-30. Epub Aug. 12, 2002.
Rodova, et al. The polycystic kidney disease-1 promoter is a target of the beta-catenin/T-cell factor pathway. J Biol Chem. Aug. 16, 2002;277(33):29577-83. Epub Jun. 4, 2002.
Roos, et al. Synthesis of alpha-substituted alpha-amino acids via cationic intermediates. J Org Chem. 1993; 58:3259-68.
Ross, et al. Inhibition of adipogenesis by Wnt signaling. Science. Aug. 11, 2000;289(5481):950-3.
Ruan et al., "Metal Ion Enhanced Helicity in Synthetic Peptides Containing Unnatural, Metal-ligating Residues," J. Am. Chem. Soc. 112:9403-9404 (1990).
Rudinger, Characteristics of the amino acids as components of a peptide hormone sequence. In: Peptide Hormones. J. A. Parsons, ed. University Park Press. Jun. 1976:1-7.
Ruffolo and Shore. BCL-2 Selectively Interacts with the BID-Induced Open Conformer of BAK, Inhibiting BAK Auto-Oligomerization. J. Biol. Chem. 2003;278(27):25039-25045.
Sampietro, et al. Crystal structure of a beta-catenin/BCL9/Tcf4 complex. Mol Cell. Oct. 20, 2006;24(2):293-300.
Sanchez-Garcia, et al. Tumorigenic activity of the BCR-ABL oncogenes is mediated by BCL2. Proc Natl Acad Sci U S A. Jun. 6, 1995;92(12):5287-91.
Satoh, et al. AXIN1 mutations in hepatocellular carcinomas, and growth suppression in cancer cells by virus-mediated transfer of AXIN1. Nat Genet. Mar. 2000;24(3):245-50.
Sattler, et al. Structure of Bcl-xL-Bak peptide complex: recognition between regulators of apoptosis. Science. Feb. 14, 1997;275(5302):983-6.
Saxon, et al. Cell surface engineering by a modified Staudinger reaction. Science. Mar. 17, 2000;287(5460):2007-10.
Schaffer et al., A novel high-affinity peptide antagonist to the insulin receptor. Biochem Biophys Res Commun. Nov. 14, 2008;376(2):380-3. doi: 10.1016/j.bbrc.2008.08.151. Epub Sep. 7, 2008.
Schaffer et al., Assembly of high-affinity insulin receptor agonists and antagonists from peptide building blocks. Proc Natl Acad Sci U S A. Apr. 15, 2003;100(8):4435-9. Epub Apr. 8, 2003.
Schafmeister, et al. An all-hydrocarbon cross-linking system for enhancing the helicity and metabolic stability of peptides. Journal of the American Chemical Society. 2000;122(24):5891-5892.
Scheffzek, et al. The Ras-RasGAP complex: structural basis for GTPase activation and its loss in oncogenic Ras mutants. Science. Jul. 18, 1997;277(5324):333-8.
Schinzel et al., The phosphate recognition site of *Escherichia coli* maltodextrin phosphorylase. FEBS Lett. Jul. 29, 1991;286(1-2):125-8.
Schmiedeberg et al., Reversible backbone protection enables combinatorial solid-phase ring-closing metathesis reaction (RCM) in peptides. Org Lett. Jan. 10, 2002;4(1):59-62.
Scholtz, et al. The mechanism of alpha-helix formation by peptides. Annu Rev Biophys Biomol Struct. 1992;21:95-118.
Schrock, et al. Tungsten(VI) neopentylidyne complexes. Organometallics. 1982; 1:1645-51.
Scorrano, et al. A distinct pathway remodels mitochondrial cristae and mobilizes cytochrome c during apoptosis. Dev Cell. Jan. 2002;2(1):55-67.
Seabra et al., Rab GTPases, intracellular traffic and disease. Trends Mol Med. Jan. 2002;8(1):23-30.
Shair. A closer view of an oncoprotein-tumor suppressor interaction. Chem Biol. Nov. 1997;4(11):791-4.
Shepherd et al., "Single Turn Peptide Alpha Helices with Exceptional Stability in Water," J. Am. Chem. Soc. 127:2974-2983 (2005).
Shiba et al., Structural basis for Rabll-dependent membrane recruitment of a family of Rabllinteracting protein 3 (FIP3)/Arfophilin-1. Proc Natl Acad Sci U S A. Oct. 17, 2006;103(42):1541621. Epub Oct. 9, 2006.
Si, et al. CCN1/Cyr61 is regulated by the canonical Wnt signal and plays an important role in Wnt3A-induced osteoblast differentiation of mesenchymal stem cells. Mol Cell Biol. Apr. 2006;26(8):2955-64.
Sia et al., "Short Constrained Peptides that Inhibit HIV-1 Entry," Proc. Nat'l Acad. Sci. USA 99(23):14664-14669 (2002).

(56) References Cited

OTHER PUBLICATIONS

Siddle et al., Specificity in ligand binding and intracellular signalling by insulin and insulin-like growth factor receptors. Biochem Soc Trans. Aug. 2001;29(Pt 4):513-25.
Skinner et al., Basic helix-loop-helix transcription factor gene family phylogenetics and nomenclature. Differentiation. Jul. 2010;80(1):1-8. doi: 10.1016/j.diff.2010.02.003. Epub Mar. 10, 2010.
Smith et al., Structural resolution of a tandem hormone-binding element in the insulin receptor and its implications for design of peptide agonists. Proc Natl Acad Sci U S A. Apr. 13, 2010;107(15):6771-6. doi: 10.1073/pnas.1001813107. Epub Mar. 26, 2010.
Soucek, et al. Modelling Myc inhibition as a cancer therapy. Nature. Oct. 2, 2008;455(7213):679-83.
Spierings, et al. Connected to death: the (unexpurgated) mitochondrial pathway of apoptosis. Science. 2005; 310:66-67.
Stein et al., Rab proteins and endocytic trafficking: potential targets for therapeutic intervention. Adv Drug Deliv Rev. Nov. 14, 2003;55(11):1421-37.
Stenmark et al., The Rab GTPase family. Genome Biol. 2001;2(5):3007.1-3007.7.
Stewart, et al. Cell-penetrating peptides as delivery vehicles for biology and medicine. Org Biomol Chem. Jul. 7, 2008;6(13):2242-55. doi: 10.1039/b719950c. Epub Apr. 15, 2008.
Still, et al. Semianalytical treatment of solvation for molecular mechanics and dynamics. J Am Chem Soc. 1990; 112:6127-29.
Stueanaes et al., Beta-adrenoceptor stimulation potentiates insulin-stimulated PKB phosphorylation in rat cardiomyocytes via cAMP and PKA. Br J Pharmacol. May 2010;160(1):116-29. doi: 10.1111/j.1476-5381.2010.00677.x.
Su, et al. Eradication of pathogenic beta-catenin by Skp1/Cullin/F box ubiquitination machinery. Proc Natl Acad Sci U S A. Oct. 28, 2003;100(22):12729-34. Epub Oct. 16, 2003.
Surinya et al., Role of insulin receptor dimerization domains in ligand binding, cooperativity, and modulation by anti-receptor antibodies. J Biol Chem. May 10, 2002;277(19):16718-25. Epub Mar. 1, 2002.
Suzuki, et al. Structure of Bax: coregulation of dimer formation and intracellular localization. Cell. Nov. 10, 2000;103(4):645-54.
Szewczuk, et al. Synthesis and biological activity of new conformationally restricted analogues of pepstatin. Int. J. Pept. Protein Res. Sep.-Oct. 1992;40(3-4):233-42.
Takeda, et al. Human sebaceous tumors harbor inactivating mutations in LEF1. Nat Med. Apr. 2006;12(4):395-7. Epub Mar. 26, 2006.
Tanaka, Design and synthesis of non-proteinogenic amino acids and secondary structures of their peptides. Yakugaku Zasshi. Oct. 2006:126(10):933-44. Japanese.
Taylor. The synthesis and study of side-chain lactam-bridged peptides. Biopolymers. 2002;66(1):49-75.
Thompson, et al. Mutants of interleukin 13 with altered reactivity toward interleukin 13 receptors. J Biol Chem. 1999; 275(42):29944-50.
Tian, et al. The role of the Wnt-signaling antagonist DKK1 in the development of osteolytic lesions in multiple myeloma. N Engl J Med. Dec. 25, 2003;349(26):2483-94.
Titus, et al. Human K/natural killer cells targeted with hetero-cross-linked antibodies specifically lyse tumor cells in vitro and prevent tumor growth in vivo. J Immunol. Nov. 1, 1987;139(9):3153-8.
Toomes, et al. Mutations in LRP5 or FZD4 underlie the common familial exudative vitreoretinopathy locus on chromosome 11q. Am J Hum Genet. Apr. 2004;74(4):721-30. Epub Mar. 2004.
Torrance, et al. Combinatorial chemoprevention of intestinal neoplasia. Nat Med. Sep. 2000;6(9):1024-8.
Trnka & Grubbs, "The Development of L2X2Ru=CHR Olefin Metathesis Catalysts: An Organometallic Success Story," Acc. Chem. Res. 34:18-29 (2001).
Tsuji, et al. Antiproliferative activity of REIC/Didc-3 and its significant down-regulation in non-small-cell lung carcinomas. Biochem Biophys Res Commun. Nov. 23, 2001;289(1):257-63.
Tugyi, et al. The effect of cyclization on the enzymatic degradation of herpes simplex virus glycoprotein D derived epitope peptide. J Pept Sci. Oct. 2005;11(10):642-9.
Tyndall et al. Macrocycles mimic the extended peptide conformation recognized by aspartic, serine, cysteine and metallo proteases. Curr Med Chem. Jul. 2001;8(8):893-907.
Uesugi, et al. The alpha-helical FXXPhiPhi motif in p53: TAF interaction and discrimination by MDM2. Proc Natl Acad Sci U S A. Dec. 21, 1999;96(26):14801-6.
Van Genderen, et al. Development of several organs that require inductive epithelial-mesenchymal interactions is impaired in LEF-1-deficient mice. Genes Dev. Nov. 15, 1994;8(22):2691-703.
Van Gun, et al.,The wnt-frizzled cascade in cardiovascular disease. Cardiovasc Res. Jul. 2002;55(1):16-24.
Varallo, et al. Beta-catenin expression in Dupuytren's disease: potential role for cell-matrix interactions in modulating beta-catenin levels in vivo and in vitro. Oncogene. Jun. 12, 2003;22(24):3680-4.
Venancio, et al.Reconstructing the ubiquitin network: cross-talk with other systems and identification of novel functions. Genome Biol. 2009;10(3):R33.
Verdine, et al. The challenge of drugging undruggable targets in cancer: lessons learned from targeting BCL-2 family members. Clin Cancer Res. Dec. 15, 2007;13(24):7264-70.
Verma, et al. Small interfering RNAs directed against beta-catenin inhibit the in vitro and in vivo growth of colon cancer cells. Clin Cancer Res. Apr. 2003;9(4):1291-300.
Viallet, et al. Tallimustine is inactive in patients with previously treated small cell lung cancer. A phase II trial of the National Cancer Institute of Canada Clinical Trials Group. Lung Cancer. Nov. 1996;15(3):367-73.
Voet et al., Biochemistry. Second Edition. John Wiley & Sons, Inc. 1995:235-241.
Walensky, et al. A stapled BID BH3 helix directly binds and activates BAX. Mol Cell. Oct. 20, 2006;24(2):199-210.
Walensky, et al. Activation of Apoptosis in Vivo by a Hydrocarbon-Stapled BH3 Helix. Science. Sep. 3, 2004;305(5689):1466-1470.
Walter, et al. Critical role for IL-13 in the development of allergen-induced airway hyperreactivity. J Immunol. Oct. 15, 2001;167(8):4668-75.
Wang et al. Cell permeable Bcl-2 binding peptides: a chemical approach to apoptosis induction in tumor cells. Cancer Res. Mar. 15, 2000;60(6):1498-502.
Wang et al. Enhanced metabolic stability and protein-binding properties of artificial alpha helices derived from a hydrogen-bond surrogate: application to Bcl-xL. Angew Chem Int Ed Engl. Oct. 14, 2005;44(40):6525-9.
Wang, 4-Alkyl-2-trichloromethyloxazolidin-5-ones: Valuable Precursors to Enantiomerically Pure C- and N-Protected a-Alkyl Prolines. Synlett. 1999;1:33-34.
Wang, et al. BID: a novel BH3 domain-only death agonist. Genes Dev. Nov. 15, 1996;10(22):2859-69.
Wang, et al. Evaluation of biologically relevant short alpha-helices stabilized by a main-chain hydrogen-bond surrogate. J Am Chem Soc. Jul. 19, 2006;128(28):9248-56.
Wang, et al. Inhibition of p53 degradation by Mdm2 acetylation. FEBS Lett. Mar. 12, 2004;561(1-3):195-201.
Wang, et al. Nucleation and stability of hydrogen-bond surrogate-based alpha-helices. Org Biomol Chem. Nov. 21, 2006;4(22):4074-81.
Wei et al., Disorder and structure in the Rab11 binding domain of Rab11 family interacting protein 2. Biochemistry. Jan. 27, 2009;48(3):549-57. doi: 10.1021/bi8020197.
Wei, et al. tBID, a membrane-targeted death ligand, oligomerizes BAK to release cytochrome c. Genes Dev. Aug. 15, 2000;14(16):2060-71.
Wild et al., "Peptides Corresponding to a Predictive α-Helical Domain of Human Immunodeficiency Virus Type 1 gp41 are Potent Inhibitors of Virus Infection," Proc. Nat'l Acad. Sci. USA 91:9770-9774 (1994).
Wilen, et al. Strategies in optical resolution. Tetrahedron. 1977; 33:2725-36.

(56) References Cited

OTHER PUBLICATIONS

Wilen, Tables of Resolving Agents and Optical Resolutions. E.L. Eliel, ed. Universtify of Notre Dame Press, Notre Dame, IN. 1972:268-98.
Williams, et al. Asymmetric Synthesis of Monosubstituted and a,a-Disubstituted a-Amino Acids via Diastereoselective Glycine Enolate Allcylations. J Am Chem Soc. 1991;113:9276-86.
Wills-Karp, et al. Interleukin-13: central mediator of allergic asthma. Science. Dec. 18, 1998;282(5397):2258-61.
Wills-Karp. Interleukin-13 in asthma pathogenesis. Immunol Rev. 2004; 202:175-90.
Wills-Karp. The gene encoding interleukin-13: a susceptibility locus for asthma and related traits. Respir Res. 2000;1(1):19-23.
Wilson et al., The FIP3-Rabll protein complex regulates recycling endosome targeting to the cleavage furrow during late cytokinesis. Mol Biol Cell. Feb. 2005;16(2):849-60. Epub Dec. 15, 2004.
Xi, et al. Use of DNA and peptide nucleic acid molecular beacons for detection and quantification of rRNA in solution and in whole cells. Appl Environ Microbiol. Sep. 2003, 69(9):5673-8.
Xing, et al. Crystal structure of a beta-catenin/axin complex suggests a mechanism for the beta-catenin destruction complex. Genes Dev. Nov. 15, 2003;17(22):2753-64. Epub Nov. 4, 2003.
Yang, et al. Therapeutic dosing with anti-interleukin-13 monoclonal antibody inhibits asthma progression in mice. J Pharmacol Exp Ther. Apr. 2005;313(1):8-15.
Yu, et al. The role of Axin2 in calvarial morphogenesis and craniosynostosis. Development. Apr. 2005;132(8):1995-2005.
Zamzami et al. The thiol crosslinking agent diamide overcomes the apoptosis-inhibitory effect of Bcl-2 by enforcing mitochondrial permeability transition. Oncogene. Feb. 26, 1998;16(8):1055-63.
Zhang, et al. 310 Helix versus alpha-helix: a molecular dynamics study of conformational preferences of Aib and Alanine. J. American Cancer Society. Dec. 1994; 116(26):11915-11921.
Zhou, et al. Identification of ubiquitin target proteins using cell-based arrays. J Proteome Res. 2007; 6:4397-4406.
Zhou, et al. Lymphoid enhancer factor 1 directs hair follicle patterning and epithelial cell fate. Genes Dev. Mar. 15, 1995;9(6):700-13.
Zhou, et al. Tyrosine kinase inhibitor STI-571/Gleevec down-regulates the beta-catenin signaling activity. Cancer Lett. Apr. 25, 2003;193(2):161-70.
Zimm et al., Theory of the Phase Transition between Helix and Random Coil in Polypeptide Chains. J Chem Phys. 1959;31:526-35.
Zor, et al. Solution structure of the KIX domain of CBP bound to the transactivation domain of c-Myb. J Mol Biol. Mar. 26, 2004;337(3):521-34.
U.S. Appl. No. 13/957,667, filed Aug. 2, 2013, Nash et al.
U.S. Appl. No. 14/070,354, filed Nov. 1, 2013, Walensky et al.
U.S. Appl. No. 14/070,367, filed Nov. 1, 2013, Nash.
Brown, et al. A spiroligomer α-helix mimic that binds HDM2, penetrates human cells and stabilizes HDM2 in cell culture. PLoS One. 2012;7(10):e45948. doi: 10.1371/journal.pone.0045948. Epub Oct. 18, 2012.
Brown, et al. Stapled peptides with improved potency and specificity that activate p53. ACS Chem Biol. Mar. 15, 2013;8(3):506-12. doi: 10.1021/cb3005148. Epub Dec. 18, 2012.
Chang, et al. Stapled α-helical peptide drug development: a potent dual inhibitor of MDM2 and MDMX for p53-dependent cancer therapy. Proc Natl Acad Sci U S A. Sep. 3, 2013;110(36):E3445-54. doi: 10.1073/pnas.1303002110. Epub Aug. 14, 2013.
David, et al. Expressed protein ligation. Method and applications. Eur J Biochem. Feb. 2004;271(4):663-77.
Grossman, et al. Inhibition of oncogenic Wnt signaling through direct targeting of—catenin. Proc. Natl. Acad. Sco. 2012; 109(44):17942-179747.
International preliminary report on patentability dated Jan. 3, 2014 for PCT/US2012/042738.
International preliminary report on patentability dated Apr. 4, 2013 for PCT/US2011/052755.
International search report and written opinion dated Jan. 30, 2014 for PCT/US2013/062929.
Ji, et al. In vivo activation of the p53 tumor suppressor pathway by an engineered cyclotide. J Am Chem Soc. Aug. 7, 2013;135(31):11623-33. doi: 10.1021/ja405108p. Epub Jul. 25, 2013.
Khalil, et al. An efficient and high yield method for the N-tert-butoxycarbonyl protection of sterically hindered amino acids. Tetrahedron Lett. 1996; 37(20):3441-44.
Office action dated Jan. 17, 2014 for U.S. Appl. No. 13/816,880.
Office action dated Feb. 6, 2014 for U.S. Appl. No. 13/680,905.
Office action dated Apr. 9, 2014 for U.S. Appl. No. 13/767,852.
Office action dated Dec. 31, 2013 for U.S. Appl. No. 12/525,123.
Pellois, et al. Semisynthetic proteins in mechanistic studies: using chemistry to go where nature can't Curr. Opin. Chem. Biol. 2006; 10(5):487-91.
Sadot, et al. Down-regulation of beta-catenin by activated p53. Mol. Cell Biol. 2001; 21(20):6768-81.
Schwarzer, et al. Protein semisynthesis and expressed protein ligation: chasing a protein's tail. Curr. Opin. Chem. Biol. 2005; 9(6):561-9.
Tolbert, et al. New methods for proteomic research: preparation of protein with N-terminal cysteines for labeling and conjugation. Angew Chem. Int. Ed. Engl. 2002; 41(12):2171-4.
Vartak, et al. Allosteric modulation of the dopamine receptor by conformationally constrained type VI B-turn peptidomimetics of Pro-Leu-Gly-NH2. J. Med. Chem. 2007; 50(26):6725-6729.
Woon, et al. Linking of 2-oxoglutarate and substrate binding sites enables potent and highly selective inhibition of JmjC histone demethylases. Angew Chem Int Ed Engl. Feb. 13, 2012;51(7):1631-4. doi: 10.1002/anie.201107833. Epub Jan. 12, 2012.

\* cited by examiner

TRIAZOLE-CROSSLINKED AND THIOETHER-CROSSLINKED PEPTIDOMIMETIC MACROCYCLES

This application claims the benefit of U.S. Provisional Application Nos. 61/599,362, filed Feb. 15, 2012, 61/723,762, filed Nov. 7, 2012, 61/599,365, filed Feb. 15, 2012, and 61/723,767, filed Nov. 7, 2012; all of which application are incorporated herein by reference.

SEQUENCE LISTING

The instant application contains a Sequence Listing which has been submitted electronically in ASCII format and is hereby incorporated by reference in its entirety. Said ASCII copy, created on Dec. 13, 2013, is named 35224-772.201_SL.txt and is 867,477 bytes in size.

BACKGROUND OF THE INVENTION

The human transcription factor protein p53 induces cell cycle arrest and apoptosis in response to DNA damage and cellular stress, and thereby plays a critical role in protecting cells from malignant transformation. The E3 ubiquitin ligase MDM2 (also known as HDM2) negatively regulates p53 function through a direct binding interaction that neutralizes the p53 transactivation activity, leads to export from the nucleus of p53 protein, and targets p53 for degradation via the ubiquitylation-proteasomal pathway. Loss of p53 activity, either by deletion, mutation, or MDM2 overexpression, is the most common defect in human cancers. Tumors that express wild type p53 are vulnerable to pharmacologic agents that stabilize or increase the concentration of active p53. In this context, inhibition of the activities of MDM2 has emerged as a validated approach to restore p53 activity and resensitize cancer cells to apoptosis in vitro and in vivo. MDMX (MDM4) has more recently been identified as a similar negative regulator of p53, and studies have revealed significant structural homology between the p53 binding interfaces of MDM2 and MDMX. The p53-MDM2 and p53-MDMX protein-protein interactions are mediated by the same 15-residue alpha-helical transactivation domain of p53, which inserts into hydrophobic clefts on the surface of MDM2 and MDMX. Three residues within this domain of p53 (F19, W23, and L26) are essential for binding to MDM2 and MDMX.

There remains a considerable need for compounds capable of binding to and modulating the activity of p53, MDM2 and/or MDMX. Provided herein are p53-based peptidomimetic macrocycles that modulate an activity of p53. Also provided herein are p53-based peptidomimetic macrocycles that inhibit the interactions between p53, MDM2 and/or MDMX proteins. Further, provided herein are p53-based peptidomimetic macrocycles that can be used for treating diseases including but not limited to cancer and other hyperproliferative diseases.

SUMMARY OF THE INVENTION

Described herein are stably cross-linked peptides related to a portion of human p53 ("p53 peptidomimetic macrocycles"). These cross-linked peptides contain at least two modified amino acids that together form an intramolecular cross-link that can help to stabilize the alpha-helical secondary structure of a portion of p53 that is thought to be important for binding of p53 to MDM2 and for binding of p53 to MDMX. Accordingly, a cross-linked polypeptide described herein can have improved biological activity relative to a corresponding polypeptide that is not cross-linked. The p53 peptidomimetic macrocycles are thought to interfere with binding of p53 to MDM2 and/or of p53 to MDMX, thereby liberating functional p53 and inhibiting its destruction. The p53 peptidomimetic macrocycles described herein can be used therapeutically, for example to treat cancers and other disorders characterized by an undesirably low level or a low activity of p53, and/or to treat cancers and other disorders characterized by an undesirably high level of activity of MDM2 or MDMX. The p53 peptidomimetic macrocycles can also be useful for treatment of any disorder associated with disrupted regulation of the p53 transcriptional pathway, leading to conditions of excess cell survival and proliferation such as cancer and autoimmunity, in addition to conditions of inappropriate cell cycle arrest and apoptosis such as neurodegeneration and immunodeficiencies. In some embodiments, the p53 peptidomimetic macrocycles bind to MDM2 (e.g., GenBank® Accession No.: 228952; GI:228952) and/or MDMX (also referred to as MDM4; GenBank® Accession No.: 88702791; GI:88702791).

In one aspect, provided herein is a peptidomimetic macrocycle comprising an amino acid sequence which is at least about 60%, 80%, 90%, or 95% identical to an amino acid sequence chosen from the group consisting of the amino acid sequences in Table 4, Table 4a, Table 4b, or Table 5. In some embodiments, the peptidomimetic macrocycle is not a peptide as shown in Table 6, Table 6a, Table 7, Table 7a, or Table 7b. In some embodiments, the peptidomimetic macrocycle has an amino acid sequence chosen from Table 4. In some embodiments, the peptidomimetic macrocycle has an amino acid sequence chosen from Table 4a. In some embodiments, the peptidomimetic macrocycle has an amino acid sequence chosen from Table 4b. In some embodiments, the peptidomimetic macrocycle has an amino acid sequence chosen from Table 5.

Alternatively, an amino acid sequence of said peptidomimetic macrocycle is chosen as above, and further wherein the macrocycle does not include an all carbon crosslink or a triazole. In some embodiments, the peptidomimetic macrocycle comprises a helix, such as an α-helix. In other embodiments, the peptidomimetic macrocycle comprises an α,α-disubstituted amino acid. A peptidomimetic macrocycle can comprise a crosslinker linking the α-positions of at least two amino acids. At least one of said two amino acids can be an α,α-disubstituted amino acid.

In some embodiments, provided are peptidomimetic macrocycle of the Formula:

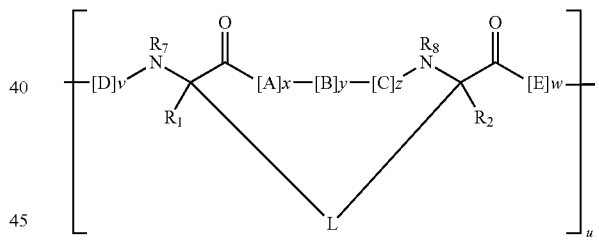

Formula (I)

wherein:
each A, C, D, and E is independently an amino acid;
B is an amino acid,

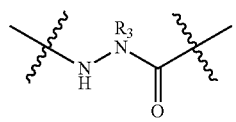

[—NH-L$_3$-CO—], [—NH-L$_3$-SO$_2$—], or [—NH-L$_3$-];
each L and L' is independently a macrocycle-forming linker of the formula

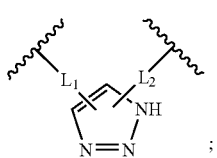

$L_1$, $L_2$ and $L_3$ are independently alkylene, alkenylene, alkynylene, heteroalkylene, cycloalkylene, heterocycloalkylene, cycloarylene, heterocycloarylene, or $[-R_4-K-R_4-]_n$, each being optionally substituted with $R_5$;

each $R_3$ is independently hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;

each $R_4$ is independently alkylene, alkenylene, alkynylene, heteroalkylene, cycloalkylene, heterocycloalkylene, arylene, or heteroarylene;

each K is independently O, S, SO, $SO_2$, CO, $CO_2$, or $CONR_3$;

each $R_5$ is independently halogen, alkyl, $-OR_6$, $-N(R_6)_2$, $-SR_6$, $-SOR_6$, $-SO_2R_6$, $-CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

each $R_7$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;

each $R_8$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

v and w are independently integers from 1-1000, for example 1-500, 1-200, 1-100, 1-50, 1-30, 1-20 or 1-10;

u is an integer from 1-10, for example 1-5, 1-3 or 1-2;

x, y and z are independently integers from 0-10, for example the sum of x+y+z is 2, 3, or 6; and n is an integer from 1-5.

In some embodiments, v and w are integers between 1-30. In some embodiments, w is an integer from 3-1000, for example 3-500, 3-200, 3-100, 3-50, 3-30, 3-20, or 3-10.

In some embodiments, the sum of x+y+z is 3 or 6. In some embodiments, the sum of x+y+z is 3. In other embodiments, the sum of x+y+z is 6.

In some embodiments, the peptidomimetic macrocycles are claimed with the proviso that when u=1 and w=2, the first C-terminal amino acid represented by E is not an Arginine (R) and/or the second C-terminal amino acid represented by E is not a Threonine (T). For instance, when u=1 and w=2, the first C-terminal amino acid and/or the second C-terminal amino acid represented by E do not comprise a positively charged side chain or a polar uncharged side chain. In some embodiments, when u=1 and w=2, the first C-terminal amino acid and/or the second C-terminal amino acid represented by E comprise a hydrophobic side chain. For example, when w=2, the first C-terminal amino acid and/or the second N-terminal amino acid represented by E comprise a hydrophobic side chain, for example a large hydrophobic side chain.

In some embodiments, w is between 3 and 1000. For example, the third amino acid represented by E comprises a large hydrophobic side chain.

Peptidomimetic macrocycles are also provided of the formula:

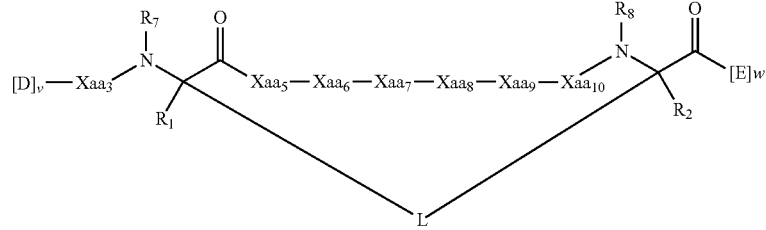

wherein:

each of $Xaa_3$, $Xaa_5$, $Xaa_6$, $Xaa_7$, $Xaa_8$, $Xaa_9$, and $Xaa_{10}$ is individually an amino acid, wherein at least three of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$His_5$-$Tyr_6$-$Trp_7$-$Ala_8$-$Gln_9$-$Leu_{10}$-$X_{11}$-$Ser_{12}$ (SEQ ID NO: 1), where each X is an amino acid;

each D and E is independently an amino acid;

$R_1$ and $R_2$ are independently —H, alkyl, alkenyl, alkynyl, arylalkyl, cycloalkyl, cycloalkylalkyl, heteroalkyl, or heterocycloalkyl, unsubstituted or substituted with halo-; or at least one of $R_1$ and $R_2$ forms a macrocycle-forming linker L' connected to the alpha position of one of said D or E amino acids;

each L and L' is independently a macrocycle-forming linker of the formula

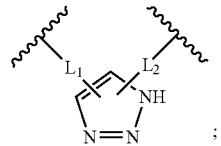

$L_1$ and $L_2$ are independently alkylene, alkenylene, alkynylene, heteroalkylene, cycloalkylene, heterocycloalkylene, cycloarylene, heterocycloarylene, or $[-R_4-K-R_4-]_n$, each being optionally substituted with $R_5$;

each $R_3$ is independently hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;

each $R_4$ is independently alkylene, alkenylene, alkynylene, heteroalkylene, cycloalkylene, heterocycloalkylene, arylene, or heteroarylene;

each K is independently O, S, SO, $SO_2$, CO, $CO_2$, or $CONR_3$;

each $R_5$ is independently halogen, alkyl, $-OR_6$, $-N(R_6)_2$, $-SR_6$, $-SOR_6$, $-SO_2R_6$, $-CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

each $R_7$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;

each $R_8$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

v is an integer from 1-1000, for example 1-500, 1-200, 1-100, 1-50, 1-30, 1-20 or 1-10;

w is an integer from 3-1000, for example 3-500, 3-200, 3-100, 3-50, 3-30, 3-20, or 3-10; and n is an integer from 1-5.

In some embodiments, the peptidomimetic macrocycle has the formula:

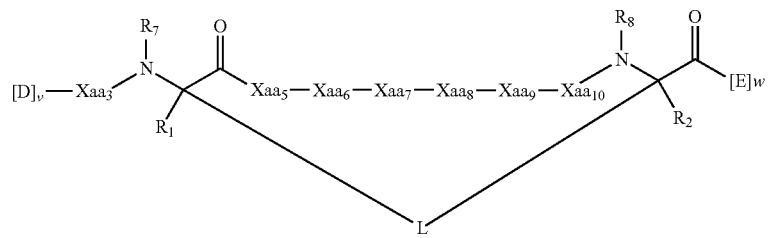

wherein:

each of $Xaa_3$, $Xaa_5$, $Xaa_6$, $Xaa_7$, $Xaa_8$, $Xaa_9$, and $Xaa_{10}$ is individually an amino acid, wherein at least three of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$Glu_5$-$Tyr_6$-$Trp_7$-$Ala_8$-$Gln_9$-$Leu_{10}$/$Cba_{10}$-$X_{11}$-$Ala_{12}$ (SEQ ID NO: 2), where each X is an amino acid;

each D and E is independently an amino acid;

$R_1$ and $R_2$ are independently —H, alkyl, alkenyl, alkynyl, arylalkyl, cycloalkyl, cycloalkylalkyl, heteroalkyl, or heterocycloalkyl, unsubstituted or substituted with halo-; or at least one of $R_1$ and $R_2$ forms a macrocycle-forming linker L' connected to the alpha position of one of said D or E amino acids;

each L and L' is independently a macrocycle-forming linker of the formula

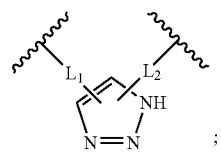

each $R_5$ is independently halogen, alkyl, —$OR_6$, —$N(R_6)_2$, —$SR_6$, —$SOR_6$, —$SO_2R_6$, —$CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

$R_7$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;

$R_8$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

v is an integer from 1-1000, for example 1-500, 1-200, 1-100, 1-50, 1-30, 1-20, or 1-10;

w is an integer from 3-1000, for example 3-500, 3-200, 3-100, 3-50, 3-30, 3-20, or 3-10; and n is an integer from 1-5.

In some embodiments, provided are peptidomimetic macrocycles of the Formula I:

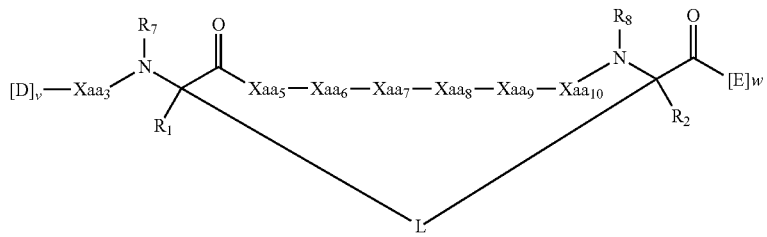

wherein:

each of $Xaa_3$, $Xaa_5$, $Xaa_6$, $Xaa_7$, $Xaa_8$, $Xaa_9$, and $Xaa_{10}$ is individually an amino acid, wherein at least three of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$His_5$-$Tyr_6$-$Trp_7$-$Ala_8$-$Gln_9$-$Leu_{10}$-$X_{11}$-$Ser_{12}$ (SEQ ID NO: 1), where each X is an amino acid;

each D and E is independently an amino acid;

$R_1$ and $R_2$ are independently —H, alkyl, alkenyl, alkynyl, arylalkyl, cycloalkyl, cycloalkylalkyl, heteroalkyl, or heterocycloalkyl, unsubstituted or substituted with halo-; or at least one of $R_1$ and $R_2$ forms a macrocycle-forming linker L' connected to the alpha position of one of said D or E amino acids;

$L_1$ and $L_2$ are independently alkylene, alkenylene, alkynylene, heteroalkylene, cycloalkylene, heterocycloalkylene, cycloarylene, heterocycloarylene, or [—$R_4$—K—$R_4$—]$_n$, each being optionally substituted with $R_5$;

$R_3$ is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;

each $R_4$ is alkylene, alkenylene, alkynylene, heteroalkylene, cycloalkylene, heterocycloalkylene, arylene, or heteroarylene;

each K is O, S, SO, $SO_2$, CO, $CO_2$, or $CONR_3$;

each L and L' is independently a macrocycle-forming linker of the formula

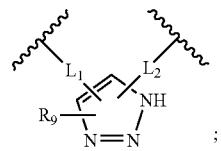

$L_1$ and $L_2$ are independently alkylene, alkenylene, alkynylene, heteroalkylene, cycloalkylene, heterocycloalkylene, cycloarylene, heterocycloarylene, or $[—R_4—K—R_4—]_n$, each being optionally substituted with $R_5$;

each $R_3$ is independently hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;

each $R_4$ is independently alkylene, alkenylene, alkynylene, heteroalkylene, cycloalkylene, heterocycloalkylene, arylene, or heteroarylene;

each K is independently O, S, SO, $SO_2$, CO, $CO_2$, or $CONR_3$;

each $R_5$ is independently halogen, alkyl, $—OR_6$, $—N(R_6)_2$, $—SR_6$, $—SOR_6$, $—SO_2R_6$, $—CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

each $R_7$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;

each $R_8$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

each $R_9$ is independently alkyl, alkenyl, alkynyl, aryl, cycloalkyl, cycloalkenyl, heteroaryl, or heterocyclyl group, unsubstituted or optionally substituted with $R_a$ and/or $R_b$;

v is an integer from 1-1000, for example 1-500, 1-200, 1-100, 1-50, 1-30, 1-20 or 1-10;

w is an integer from 3-1000, for example 3-500, 3-200, 3-100, 3-50, 3-30, 3-20, or 3-10; and n is an integer from 1-5.

In some embodiments, provided are peptidomimetic macrocycles of the Formula I:

$R_1$ and $R_2$ are independently —H, alkyl, alkenyl, alkynyl, arylalkyl, cycloalkyl, cycloalkylalkyl, heteroalkyl, or heterocycloalkyl, unsubstituted or substituted with halo-; or at least one of $R_1$ and $R_2$ forms a macrocycle-forming linker L' connected to the alpha position of one of said D or E amino acids;

each L and L' is independently a macrocycle-forming linker of the formula

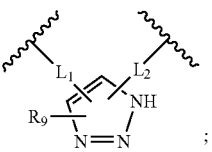

$L_1$ and $L_2$ are independently alkylene, alkenylene, alkynylene, heteroalkylene, cycloalkylene, heterocycloalkylene, cycloarylene, heterocycloarylene, or $[—R_4—K—R_4—]_n$, each being optionally substituted with $R_5$;

$R_3$ is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;

each $R_4$ is alkylene, alkenylene, alkynylene, heteroalkylene, cycloalkylene, heterocycloalkylene, arylene, or heteroarylene;

each K is O, S, SO, $SO_2$, CO, $CO_2$, or $CONR_3$;

each $R_5$ is independently halogen, alkyl, $—OR_6$, $—N(R_6)_2$, $—SR_6$, $—SOR_6$, $—SO_2R_6$, $—CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

$R_7$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;

$R_8$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

each $R_9$ is independently alkyl, alkenyl, alkynyl, aryl, cycloalkyl, cycloalkenyl, heteroaryl, or heterocyclyl group, unsubstituted or optionally substituted with $R_a$ and/or $R_b$;

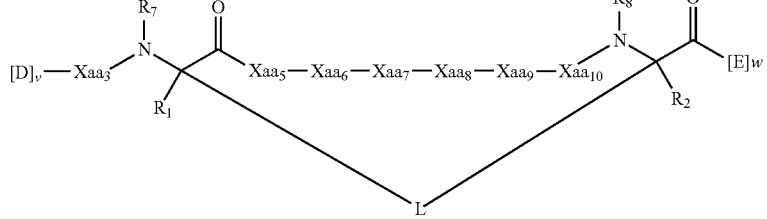

wherein:

each of $Xaa_3$, $Xaa_5$, $Xaa_6$, $Xaa_7$, $Xaa_8$, $Xaa_9$, and $Xaa_{10}$ is individually an amino acid, wherein at least three of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$Glu_5$-$Tyr_6$-$Trp_7$-$Ala_8$-$Gln_9$-$Leu_{10}$-$Cba_{10}$-$X_{11}$-$Ala_{12}$ (SEQ ID NO: 2), where each X is an amino acid;

each D and E is independently an amino acid;

v is an integer from 1-1000, for example 1-500, 1-200, 1-100, 1-50, 1-30, 1-20, or 1-10;

w is an integer from 3-1000, for example 3-500, 3-200, 3-100, 3-50, 3-30, 3-20, or 3-10; and n is an integer from 1-5.

In some embodiments, provided are peptidomimetic macrocycles of the Formula I, comprising an amino acid sequence which is at least about 60% identical to an amino acid sequence chosen from the group consisting of the amino acid sequences in Tables 4, 4a, or 4b, wherein the peptidomimetic macrocycle has the formula:

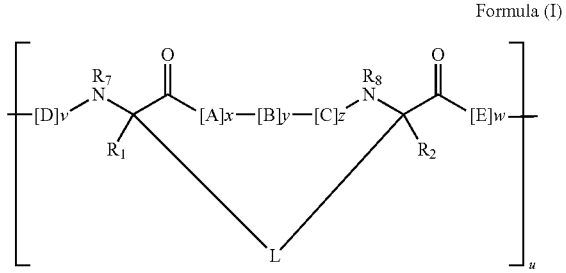

Formula (I)

wherein:
each A, C, D, and E is independently an amino acid;
B is an amino acid,

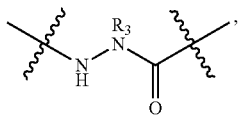

[—NH-L$_3$-CO—], [—NH-L$_3$-SO$_2$—], or [—NH-L$_3$-];

R$_1$ and R$_2$ are independently —H, alkyl, alkenyl, alkynyl, arylalkyl, cycloalkyl, cycloalkylalkyl, heteroalkyl, or heterocycloalkyl, unsubstituted or substituted with halo-; or at least one of R$_1$ and R$_2$ forms a macrocycle-forming linker L' connected to the alpha position of one of said D or E amino acids;

each L and L' is independently a macrocycle-forming linker of the formula

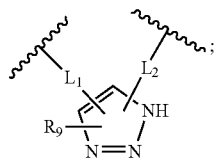

L$_1$, L$_2$ and L$_3$ are independently alkylene, alkenylene, alkynylene, heteroalkylene, cycloalkylene, heterocycloalkylene, cycloarylene, heterocycloarylene, or [—R$_4$—K—R$_4$—]$_n$, each being optionally substituted with R$_5$;

each R$_3$ is independently hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with R$_5$;

each R$_4$ is independently alkylene, alkenylene, alkynylene, heteroalkylene, cycloalkylene, heterocycloalkylene, arylene, or heteroarylene;

each K is independently O, S, SO, SO$_2$, CO, CO$_2$, or CONR$_3$;

each R$_5$ is independently halogen, alkyl, —OR$_6$, —N(R$_6$)$_2$, —SR$_6$, —SOR$_6$, —SO$_2$R$_6$, —CO$_2$R$_6$, a fluorescent moiety, a radioisotope or a therapeutic agent;

each R$_6$ is independently —H, alkyl, alkenyl, alkynyl, arylalkyl, cycloalkylalkyl, heterocycloalkyl, a fluorescent moiety, a radioisotope or a therapeutic agent;

each R$_7$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with R$_5$, or part of a cyclic structure with a D residue;

each R$_8$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with R$_5$, or part of a cyclic structure with an E residue;

each R$_9$ is independently alkyl, alkenyl, alkynyl, aryl, cycloalkyl, cycloalkenyl, heteroaryl, or heterocyclyl group, unsubstituted or optionally substituted with R$_a$ and/or R$_b$;

v and w are independently integers from 1-1000, for example 1-500, 1-200, 1-100, 1-50, 1-30, 1-20 or 1-10;

u is an integer from 1-10, for example 1-5, 1-3 or 1-2;

x, y and z are independently integers from 0-10, for example the sum of x+y+z is 2, 3, or 6; and n is an integer from 1-5.

In some embodiments, provided are peptidomimetic macrocycle of the Formula II:

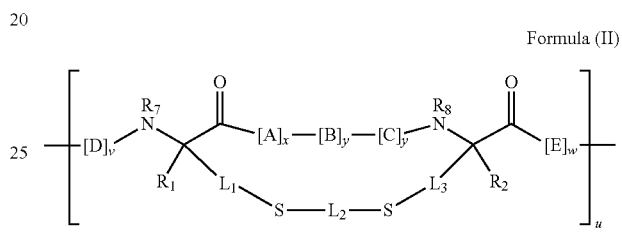

Formula (II)

wherein:
each A, C, D, and E is independently an amino acid;
B is an amino acid,

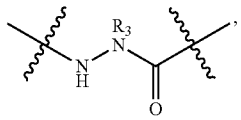

[—NH-L$_4$-CO—], [—NH-L$_4$-SO$_2$—], or [—NH-L$_4$-];

R$_1$ and R$_2$ are independently —H, alkyl, alkenyl, alkynyl, arylalkyl, cycloalkyl, cycloalkylalkyl, heteroalkyl, or heterocycloalkyl, unsubstituted or substituted with halo-; or at least one of R$_1$ and R$_2$ forms a macrocycle-forming linker L' connected to the alpha position of one of said D or E amino acids;

R$_3$ is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with R$_5$;

L$_1$, L$_2$, L$_3$ and L$_4$ are independently alkylene, alkenylene, alkynylene, heteroalkylene, cycloalkylene, heterocycloalkylene, cycloarylene, heterocycloarylene or [—R$_4$—K—R$_4$-]n, each being unsubstituted or substituted with R$_5$;

each K is O, S, SO, SO$_2$, CO, CO$_2$, or CONR$_3$;

each R$_4$ is alkylene, alkenylene, alkynylene, heteroalkylene, cycloalkylene, heterocycloalkylene, arylene, or heteroarylene;

each R$_5$ is independently halogen, alkyl, —OR$_6$, —N(R$_6$)$_2$, —SR$_6$, —SOR$_6$, —SO$_2$R$_6$, —CO$_2$R$_6$, a fluorescent moiety, a radioisotope or a therapeutic agent;

each R$_6$ is independently —H, alkyl, alkenyl, alkynyl, arylalkyl, cycloalkylalkyl, heterocycloalkyl, a fluorescent moiety, a radioisotope or a therapeutic agent;

R$_7$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with R$_5$, or part of a cyclic structure with a D residue;

$R_8$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

v and w are independently integers from 1-1000, for example 1-500, 1-200, 1-100, 1-50, 1-30, 1-20 or 1-10;

u is an integer from 1-10, for example 1-5, 1-3 or 1-2;

x, y and z are independently integers from 0-10, for example the sum of x+y+z is 2, 3, or 6; and n is an integer from 1-5.

In some embodiments, the peptidomimetic macrocycles are claimed with the proviso that when u=1 and w=2, the first C-terminal amino acid represented by E is not an Arginine (R) and/or the second C-terminal amino acid represented by E is not a Threonine (T). For instance, when u=1 and w=2, the first C-terminal amino acid and/or the second C-terminal amino acid represented by E do not comprise a positively charged side chain or a polar uncharged side chain. In some embodiments, when u=1 and w=2, the first C-terminal amino acid and/or the second C-terminal amino acid represented by E comprise a hydrophobic side chain. For example, when w=2, the first C-terminal amino acid and/or the second N-terminal amino acid represented by E comprise a hydrophobic side chain, for example a large hydrophobic side chain.

In some embodiments, w is between 3 and 1000. For example, the third amino acid represented by E comprises a large hydrophobic side chain.

Peptidomimetic macrocycles are also provided of the formula:

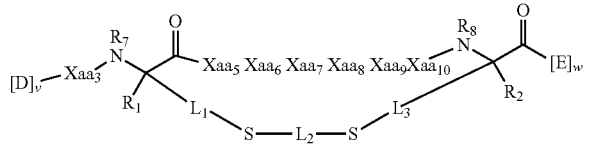

wherein:

each of $Xaa_3$, $Xaa_5$, $Xaa_6$, $Xaa_7$, $Xaa_8$, $Xaa_9$, and $Xaa_{10}$ is individually an amino acid, wherein at least three of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$His_5$-$Tyr_6$-$Trp_7$-$Ala_8$-$Gln_9$-$Leu_{10}$-$X_{11}$-$Ser_{12}$ (SEQ ID NO: 1), where each X is an amino acid;

each D and E is independently an amino acid;

$R_1$ and $R_2$ are independently —H, alkyl, alkenyl, alkynyl, arylalkyl, cycloalkyl, cycloalkylalkyl, heteroalkyl, or heterocycloalkyl, unsubstituted or substituted with halo-; or at least one of $R_1$ and $R_2$ forms a macrocycle-forming linker L' connected to the alpha position of one of said D or E amino acids;

$L_1$, $L_2$, $L_3$ and $L_4$ are independently alkylene, alkenylene, alkynylene, heteroalkylene, cycloalkylene, heterocycloalkylene, cycloarylene, heterocycloarylene or [—$R_4$—K—$R_4$-]n, each being unsubstituted or substituted with $R_5$;

each K is O, S, SO, $SO_2$, CO, $CO_2$, or $CONR_3$;

$R_3$ is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;

each $R_4$ is alkylene, alkenylene, alkynylene, heteroalkylene, cycloalkylene, heterocycloalkylene, arylene, or heteroarylene;

each $R_5$ is independently halogen, alkyl, —$OR_6$, —$N(R_6)_2$, —$SR_6$, —$SOR_6$, —$SO_2R_6$, —$CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

$R_7$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;

$R_8$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

v is an integer from 1-1000, for example 1-500, 1-200, 1-100, 1-50, 1-30, 1-20 or 1-10;

w is an integer from 3-1000, for example 3-500, 3-200, 3-100, 3-50, 3-30, 3-20, or 3-10; and n is an integer from 1-5.

Peptidomimetic macrocycles are also provided of the formula:

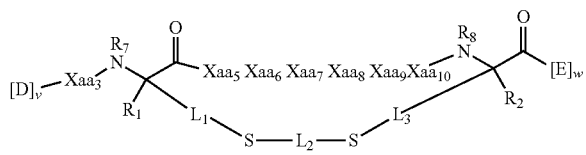

wherein:

each of $Xaa_3$, $Xaa_5$, $Xaa_6$, $Xaa_7$, $Xaa_8$, $Xaa_9$, and $Xaa_{10}$ is individually an amino acid, wherein at least three of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$Glu_5$-$Tyr_6$-$Trp_7$-$Ala_8$-$Gln_9$-$Leu_{10}$/$Cba_{10}$-$X_{11}$-$Ala_{12}$ (SEQ ID NO: 2), where each X is an amino acid;

each D and E is independently an amino acid;

$R_1$ and $R_2$ are independently —H, alkyl, alkenyl, alkynyl, arylalkyl, cycloalkyl, cycloalkylalkyl, heteroalkyl, or heterocycloalkyl, unsubstituted or substituted with halo-; or at least one of $R_1$ and $R_2$ forms a macrocycle-forming linker L' connected to the alpha position of one of said D or E amino acids;

$L_1$, $L_2$, $L_3$ and $L_4$ are independently alkylene, alkenylene, alkynylene, heteroalkylene, cycloalkylene, heterocycloalkylene, cycloarylene, heterocycloarylene or [—$R_4$—K—$R_4$-]n, each being unsubstituted or substituted with $R_5$;

each K is O, S, SO, $SO_2$, CO, $CO_2$, or $CONR_3$;

$R_3$ is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;

each $R_4$ is alkylene, alkenylene, alkynylene, heteroalkylene, cycloalkylene, heterocycloalkylene, arylene, or heteroarylene;

each $R_5$ is independently halogen, alkyl, —$OR_6$, —$N(R_6)_2$, —$SR_6$, —$SOR_6$, —$SO_2R_6$, —$CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

$R_7$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;

$R_8$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

v is an integer from 1-1000, for example 1-500, 1-200, 1-100, 1-50, 1-30, 1-20, or 1-10;

w is an integer from 3-1000, for example 3-500, 3-200, 3-100, 3-50, 3-30, 3-20, or 3-10; and n is an integer from 1-5.

In some embodiments, each E is independently an amino acid selected from Ala (alanine), D-Ala (D-alanine), Aib (α-aminoisobutyric acid), Sar (N-methyl glycine), and Ser (serine). In some embodiments, $[D]_v$ is $-Leu_1-Thr_2$.

In some embodiments, w is an integer from 3-10, for example 3-6, 3-8, 6-8, or 6-10. In some embodiments, w is 3. In other embodiments, w is 6. In some embodiments, v is an integer from 1-10, for example 2-5. In some embodiments, v is 2.

In some embodiments, the peptidomimetic macrocycle has improved binding affinity to MDM2 or MDMX relative to a corresponding peptidomimetic macrocycle where w is 0, 1 or 2. In other instances, the peptidomimetic macrocycle has a reduced ratio of binding affinities to MDMX versus MDM2 relative to a corresponding peptidomimetic macrocycle where w is 0, 1 or 2. In still other instances, the peptidomimetic macrocycle has improved in vitro anti-tumor efficacy against p53 positive tumor cell lines relative to a corresponding peptidomimetic macrocycle where w is 0, 1 or 2. In some embodiments, the peptidomimetic macrocycle shows improved in vitro induction of apoptosis in p53 positive tumor cell lines relative to a corresponding peptidomimetic macrocycle where w is 0, 1 or 2. In other instances, the peptidomimetic macrocycle of claim 1, wherein the peptidomimetic macrocycle has an improved in vitro anti-tumor efficacy ratio for p53 positive versus p53 negative or mutant tumor cell lines relative to a corresponding peptidomimetic macrocycle where w is 0, 1 or 2. In some instances the improved efficacy ratio in vitro, is 1-29, ≥30-49, or ≥50. In still other instances, the peptidomimetic macrocycle has improved in vivo anti-tumor efficacy against p53 positive tumors relative to a corresponding peptidomimetic macrocycle where w is 0, 1 or 2. In some instances the improved efficacy ratio in vivo is −29, ≥30-49, or ≥50. In yet other instances, the peptidomimetic macrocycle has improved in vivo induction of apoptosis in p53 positive tumors relative to a corresponding peptidomimetic macrocycle where w is 0, 1 or 2. In some embodiments, the peptidomimetic macrocycle has improved cell permeability relative to a corresponding peptidomimetic macrocycle where w is 0, 1 or 2. In other cases, the peptidomimetic macrocycle has improved solubility relative to a corresponding peptidomimetic macrocycle where w is 0, 1 or 2.

In some embodiments, $Xaa_5$ is Glu or an amino acid analog thereof. In some embodiments, $Xaa_5$ is Glu or an amino acid analog thereof and wherein the peptidomimetic macrocycle has an improved property, such as improved binding affinity, improved solubility, improved cellular efficacy, improved cell permeability, improved in vivo or in vitro anti-tumor efficacy, or improved induction of apoptosis relative to a corresponding peptidomimetic macrocycle where $Xaa_5$ is Ala.

In some embodiments, the peptidomimetic macrocycle has improved binding affinity to MDM2 or MDMX relative to a corresponding peptidomimetic macrocycle where $Xaa_5$ is Ala. In other embodiments, the peptidomimetic macrocycle has a reduced ratio of binding affinities to MDMX vs MDM2 relative to a corresponding peptidomimetic macrocycle where $Xaa_5$ is Ala. In some embodiments, the peptidomimetic macrocycle has improved solubility relative to a corresponding peptidomimetic macrocycle where $Xaa_5$ is Ala, or the peptidomimetic macrocycle has improved cellular efficacy relative to a corresponding peptidomimetic macrocycle where $Xaa_5$ is Ala.

In some embodiments, $Xaa_5$ is Glu or an amino acid analog thereof and wherein the peptidomimetic macrocycle has improved biological activity, such as improved binding affinity, improved solubility, improved cellular efficacy, improved helicity, improved cell permeability, improved in vivo or in vitro anti-tumor efficacy, or improved induction of apoptosis relative to a corresponding peptidomimetic macrocycle where $Xaa_5$ is Ala.

In some embodiments, the peptidomimetic macrocycle has an activity against a p53+/+ cell line which is at least 2-fold, 3-fold, 5-fold, 10-fold, 20-fold, 30-fold, 50-fold, 70-fold, or 100-fold greater than its binding affinity against a p53−/− cell line. In some embodiments, the peptidomimetic macrocycle has an activity against a p53+/+ cell line which is between 1 and 29-fold, between 30 and 49-fold, or ≥50-fold greater than its binding affinity against a p53−/− cell line. Activity can be measured, for example, as an IC50 value. For example, the p53+/+ cell line is SJSA-1, RKO, HCT-116, or MCF-7 and the p53−/− cell line is RKO-E6 or SW-480. In some embodiments, the peptide has an IC50 against the p53+/+ cell line of less than 1 µM.

In some embodiments, $Xaa_5$ is Glu or an amino acid analog thereof and the peptidomimetic macrocycle has an activity against a p53+/+ cell line which is at least 10-fold greater than its binding affinity against a p53−/− cell line.

Additionally, a method is provided of treating cancer in a subject comprising administering to the subject a peptidomimetic macrocycle. Also provided is a method of modulating the activity of p53 or MDM2 or MDMX in a subject comprising administering to the subject a peptidomimetic macrocycle, or a method of antagonizing the interaction between p53 and MDM2 and/or MDMX proteins in a subject comprising administering to the subject such a peptidomimetic macrocycle.

INCORPORATION BY REFERENCE

All publications, patents, and patent applications mentioned in this specification are herein incorporated by reference to the same extent as if each individual publication, patent, or patent application was specifically and individually indicated to be incorporated by reference.

DETAILED DESCRIPTION OF THE INVENTION

As used herein, the term "macrocycle" refers to a molecule having a chemical structure including a ring or cycle formed by at least 9 covalently bonded atoms.

As used herein, the term "peptidomimetic macrocycle" or "crosslinked polypeptide" refers to a compound comprising a plurality of amino acid residues joined by a plurality of peptide bonds and at least one macrocycle-forming linker which forms a macrocycle between a first naturally-occurring or non-naturally-occurring amino acid residue (or analog) and a second naturally-occurring or non-naturally-occurring amino acid residue (or analog) within the same molecule. Peptidomimetic macrocycle include embodiments where the macrocycle-forming linker connects the α carbon of the first amino acid residue (or analog) to the α carbon of the second amino acid residue (or analog). The peptidomimetic macrocycles optionally include one or more non-peptide bonds between one or more amino acid residues and/or amino acid analog residues, and optionally include one or more non-naturally-occurring amino acid residues or amino acid analog residues in addition to any which form the macrocycle. A "corresponding uncrosslinked polypeptide" when referred to in the context of a peptidomimetic macrocycle is understood to relate to a polypeptide of the same length as the macrocycle and comprising the equivalent natural amino acids of the wild-type sequence corresponding to the macrocycle.

As used herein, the term "stability" refers to the maintenance of a defined secondary structure in solution by a peptidomimetic macrocycle as measured by circular dichroism, NMR or another biophysical measure, or resistance to proteolytic degradation in vitro or in vivo. Non-limiting examples of secondary structures contemplated herein are α-helices, $3_{10}$ helices, β-turns, and β-pleated sheets.

As used herein, the term "helical stability" refers to the maintenance of α helical structure by a peptidomimetic macrocycle as measured by circular dichroism or NMR. For example, in some embodiments, a peptidomimetic macrocycle exhibits at least a 1.25, 1.5, 1.75 or 2-fold increase in α-helicity as determined by circular dichroism compared to a corresponding uncrosslinked macrocycle.

The term "amino acid" refers to a molecule containing both an amino group and a carboxyl group. Suitable amino acids include, without limitation, both the D- and L-isomers of the naturally-occurring amino acids, as well as non-naturally occurring amino acids prepared by organic synthesis or other metabolic routes. The term amino acid, as used herein, includes without limitation α-amino acids, natural amino acids, non-natural amino acids, and amino acid analogs.

The term "α-amino acid" refers to a molecule containing both an amino group and a carboxyl group bound to a carbon which is designated the α-carbon.

The term "β-amino acid" refers to a molecule containing both an amino group and a carboxyl group in a β configuration.

The term "naturally occurring amino acid" refers to any one of the twenty amino acids commonly found in peptides synthesized in nature, and known by the one letter abbreviations A, R, N, C, D, Q, E, G, H, I, L, K, M, F, P, S, T, W, Y and V.

The following table shows a summary of the properties of natural amino acids:

| Amino Acid | 3-Letter Code | 1-Letter Code | Side-chain Polarity | Side-chain charge (pH 7.4) | Hydropathy Index |
|---|---|---|---|---|---|
| Alanine | Ala | A | nonpolar | neutral | 1.8 |
| Arginine | Arg | R | polar | positive | −4.5 |
| Asparagine | Asn | N | polar | neutral | −3.5 |
| Aspartic acid | Asp | D | polar | negative | −3.5 |
| Cysteine | Cys | C | polar | neutral | 2.5 |
| Glutamic acid | Glu | E | polar | negative | −3.5 |
| Glutamine | Gln | Q | polar | neutral | −3.5 |
| Glycine | Gly | G | nonpolar | neutral | −0.4 |
| Histidine | His | H | polar | positive(10%) neutral(90%) | −3.2 |
| Isoleucine | Ile | I | nonpolar | neutral | 4.5 |
| Leucine | Leu | L | nonpolar | neutral | 3.8 |
| Lysine | Lys | K | polar | positive | −3.9 |
| Methionine | Met | M | nonpolar | neutral | 1.9 |
| Phenylalanine | Phe | F | nonpolar | neutral | 2.8 |
| Proline | Pro | P | nonpolar | neutral | −1.6 |
| Serine | Ser | S | polar | neutral | −0.8 |
| Threonine | Thr | T | polar | neutral | −0.7 |
| Tryptophan | Trp | W | nonpolar | neutral | −0.9 |
| Tyrosine | Tyr | Y | polar | neutral | −1.3 |
| Valine | Val | V | nonpolar | neutral | 4.2 |

"Hydrophobic amino acids" include, without limitation, small hydrophobic amino acids and large hydrophobic amino acids. "Small hydrophobic amino acid" are glycine, alanine, proline, and analogs thereof. "Large hydrophobic amino acids" are valine, leucine, isoleucine, phenylalanine, methionine, tryptophan, and analogs thereof. "Polar amino acids" are serine, threonine, asparagine, glutamine, cysteine, tyrosine, and analogs thereof. "Charged amino acids" are lysine, arginine, histidine, aspartate, glutamate, and analogs thereof.

The term "amino acid analog" refers to a molecule which is structurally similar to an amino acid and which can be substituted for an amino acid in the formation of a peptidomimetic macrocycle. Amino acid analogs include, without limitation, β-amino acids and amino acids where the amino or carboxy group is substituted by a similarly reactive group (e.g., substitution of the primary amine with a secondary or tertiary amine, or substitution of the carboxy group with an ester).

The term "non-natural amino acid" refers to an amino acid which is not one of the twenty amino acids commonly found in peptides synthesized in nature, and known by the one letter abbreviations A, R, N, C, D, Q, E, G, H, I, L, K, M, F, P, S, T, W, Y and V. Non-natural amino acids or amino acid analogs include, without limitation, structures according to the following:

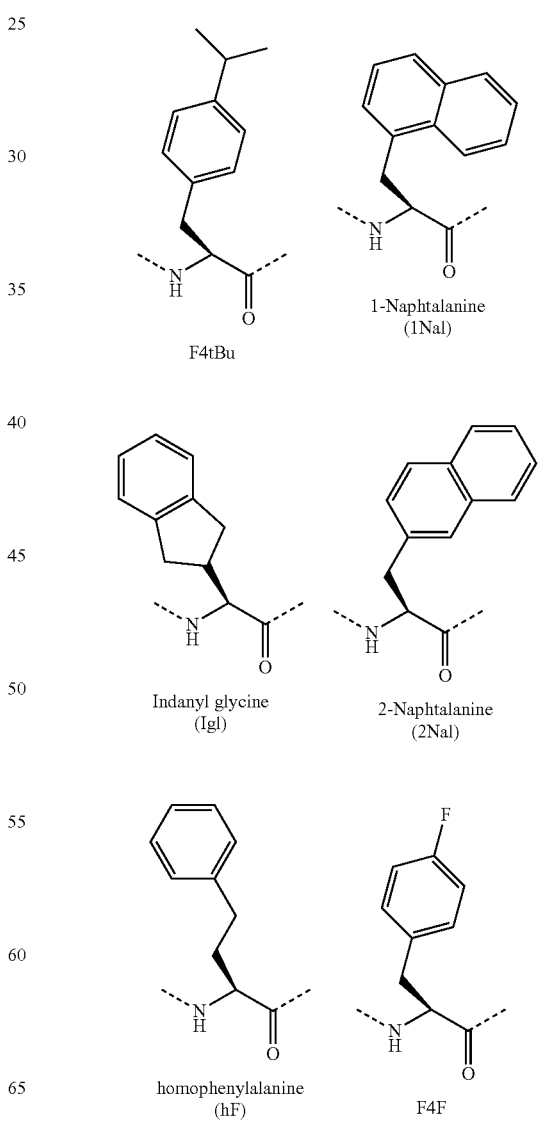

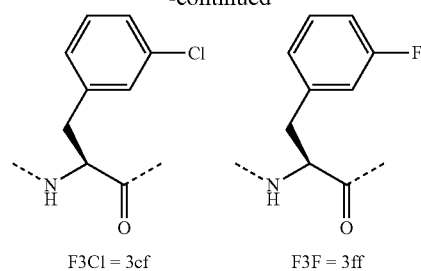
F3Cl = 3cf          F3F = 3ff
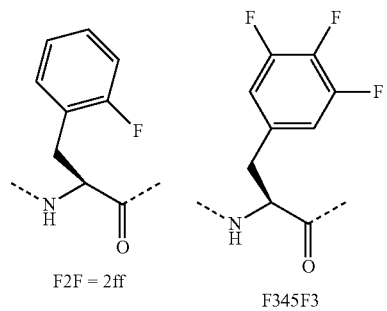
F2F = 2ff          F345F3
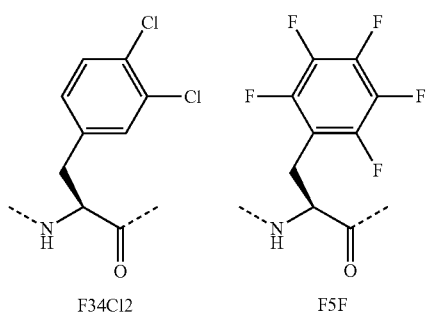
F34Cl2          F5F
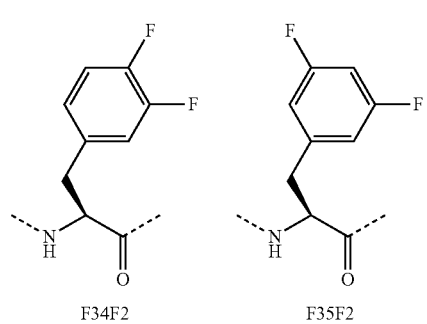
F34F2          F35F2
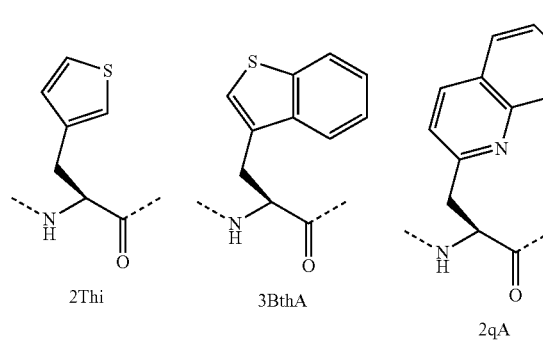
2Thi          3BthA          2qA
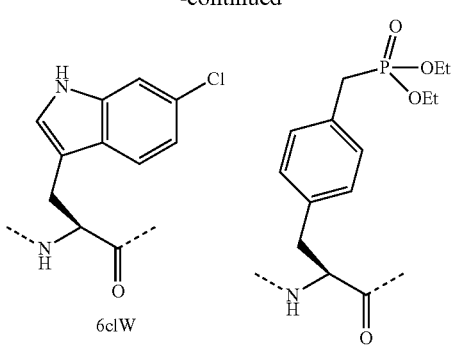
6clW          pmpEt
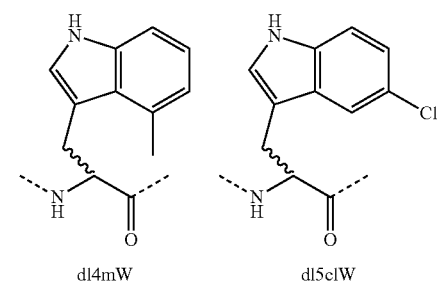
dl4mW          dl5clW
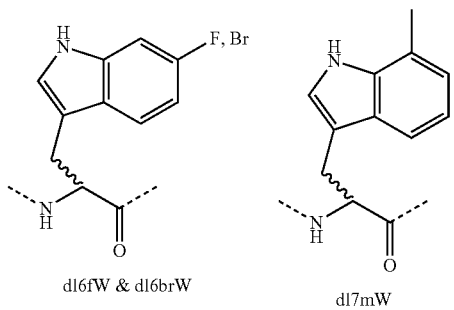
dl6fW & dl6brW          dl7mW
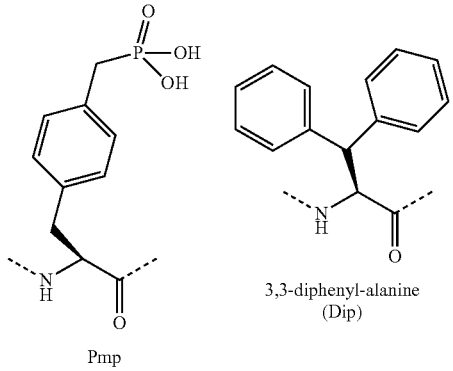
Pmp          3,3-diphenyl-alanine (Dip)
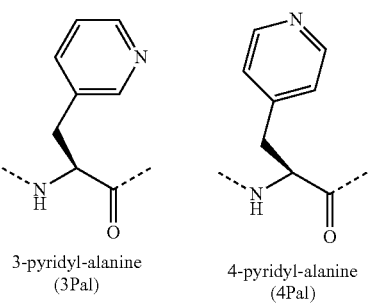
3-pyridyl-alanine (3Pal)          4-pyridyl-alanine (4Pal)

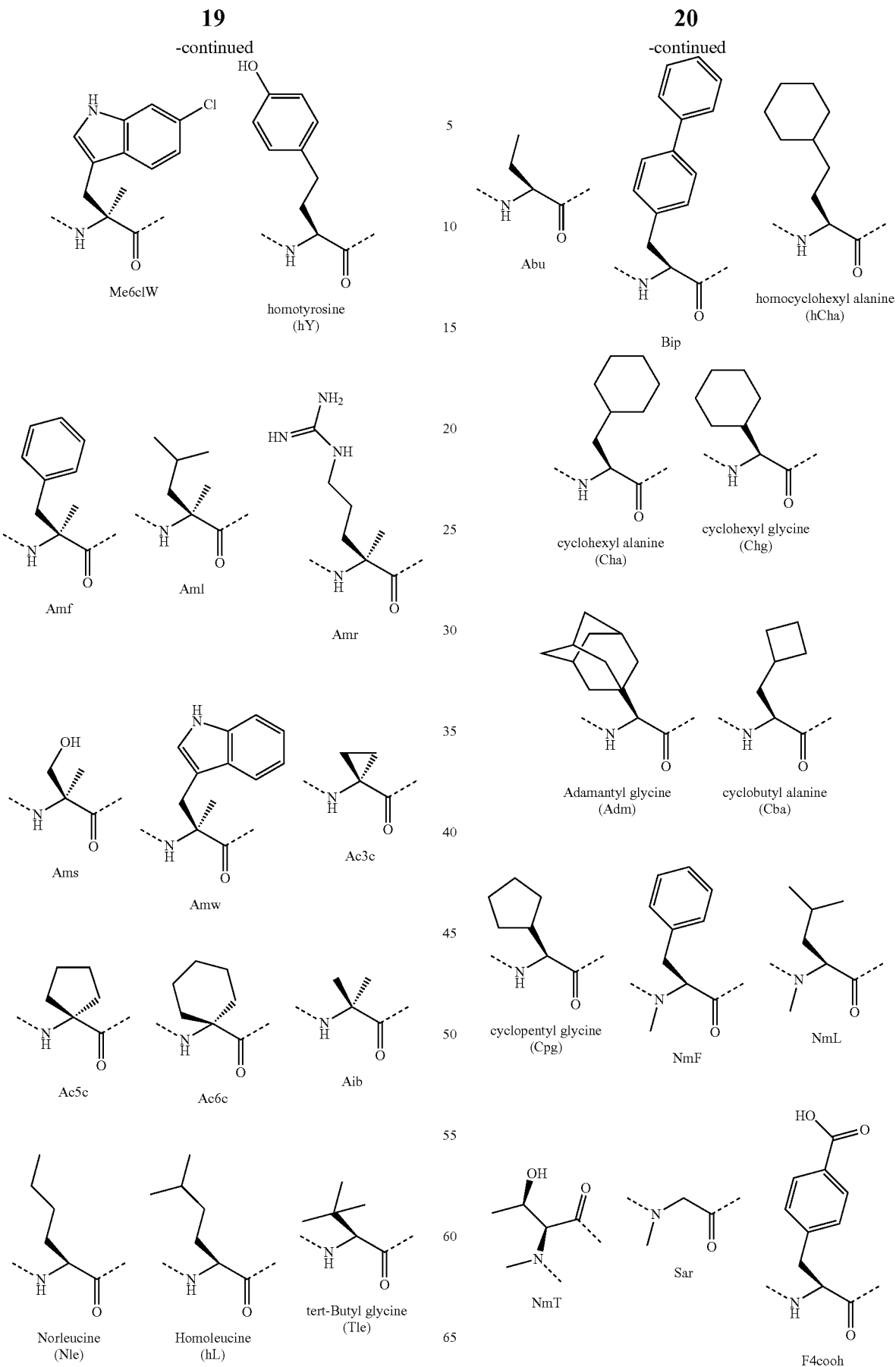

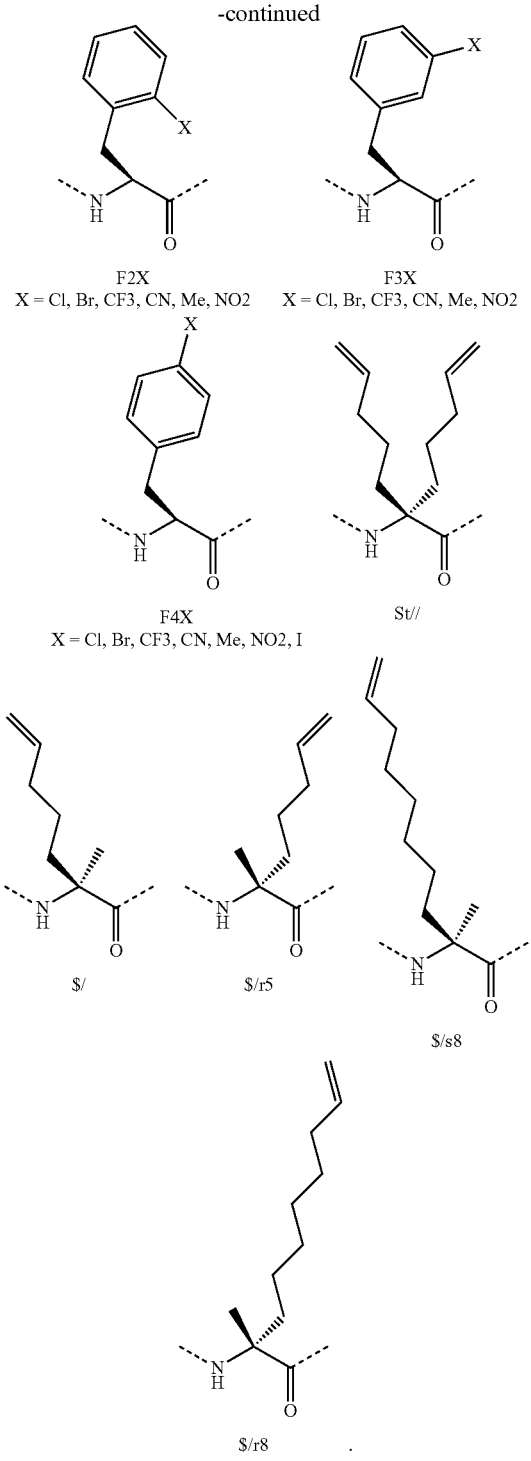

Amino acid analogs include β-amino acid analogs. Examples of β-amino acid analogs include, but are not limited to, the following: cyclic β-amino acid analogs; β-alanine; (R)-β-phenylalanine; (R)-1,2,3,4-tetrahydro-isoquinoline-3-acetic acid; (R)-3-amino-4-(1-naphthyl)-butyric acid; (R)-3-amino-4-(2,4-dichlorophenyl)butyric acid; (R)-3-amino-4-(2-chlorophenyl)-butyric acid; (R)-3-amino-4-(2-cyanophenyl)-butyric acid; (R)-3-amino-4-(2-fluorophenyl)-butyric acid; (R)-3-amino-4-(2-furyl)-butyric acid; (R)-3-amino-4-(2-methylphenyl)-butyric acid; (R)-3-amino-4-(2-naphthyl)-butyric acid; (R)-3-amino-4-(2-thienyl)-butyric acid; (R)-3-amino-4-(2-trifluoromethylphenyl)-butyric acid; (R)-3-amino-4-(3,4-dichlorophenyl)butyric acid; (R)-3-amino-4-(3,4-difluorophenyl)butyric acid; (R)-3-amino-4-(3-benzothienyl)-butyric acid; (R)-3-amino-4-(3-chlorophenyl)-butyric acid; (R)-3-amino-4-(3-cyanophenyl)-butyric acid; (R)-3-amino-4-(3-fluorophenyl)-butyric acid; (R)-3-amino-4-(3-methylphenyl)-butyric acid; (R)-3-amino-4-(3-pyridyl)-butyric acid; (R)-3-amino-4-(3-thienyl)-butyric acid; (R)-3-amino-4-(3-trifluoromethylphenyl)-butyric acid; (R)-3-amino-4-(4-bromophenyl)-butyric acid; (R)-3-amino-4-(4-chlorophenyl)-butyric acid; (R)-3-amino-4-(4-cyanophenyl)-butyric acid; (R)-3-amino-4-(4-fluorophenyl)-butyric acid; (R)-3-amino-4-(4-iodophenyl)-butyric acid; (R)-3-amino-4-(4-methylphenyl)-butyric acid; (R)-3-amino-4-(4-nitrophenyl)-butyric acid; (R)-3-amino-4-(4-pyridyl)-butyric acid; (R)-3-amino-4-(4-trifluoromethylphenyl)-butyric acid; (R)-3-amino-4-pentafluoro-phenylbutyric acid; (R)-3-amino-5-hexenoic acid; (R)-3-amino-5-hexynoic acid; (R)-3-amino-5-phenylpentanoic acid; (R)-3-amino-6-phenyl-5-hexenoic acid; (S)-1,2,3,4-tetrahydro-isoquinoline-3-acetic acid; (S)-3-amino-4-(1-naphthyl)-butyric acid; (S)-3-amino-4-(2,4-dichlorophenyl)butyric acid; (S)-3-amino-4-(2-chlorophenyl)-butyric acid; (S)-3-amino-4-(2-cyanophenyl)-butyric acid; (S)-3-amino-4-(2-fluorophenyl)-butyric acid; (S)-3-amino-4-(2-furyl)-butyric acid; (S)-3-amino-4-(2-methylphenyl)-butyric acid; (S)-3-amino-4-(2-naphthyl)-butyric acid; (S)-3-amino-4-(2-thienyl)-butyric acid; (S)-3-amino-4-(2-trifluoromethylphenyl)-butyric acid; (S)-3-amino-4-(3,4-dichlorophenyl)butyric acid; (S)-3-amino-4-(3,4-difluorophenyl)butyric acid; (S)-3-amino-4-(3-benzothienyl)-butyric acid; (S)-3-amino-4-(3-chlorophenyl)-butyric acid; (S)-3-amino-4-(3-cyanophenyl)-butyric acid; (S)-3-amino-4-(3-fluorophenyl)-butyric acid; (S)-3-amino-4-(3-methylphenyl)-butyric acid; (S)-3-amino-4-(3-pyridyl)-butyric acid; (S)-3-amino-4-(3-thienyl)-butyric acid; (S)-3-amino-4-(3-trifluoromethylphenyl)-butyric acid; (S)-3-amino-4-(4-bromophenyl)-butyric acid; (S)-3-amino-4-(4-chlorophenyl)-butyric acid; (S)-3-amino-4-(4-cyanophenyl)-butyric acid; (S)-3-amino-4-(4-fluorophenyl)-butyric acid; (S)-3-amino-4-(4-iodophenyl)-butyric acid; (S)-3-amino-4-(4-methylphenyl)-butyric acid; (S)-3-amino-4-(4-nitrophenyl)-butyric acid; (S)-3-amino-4-(4-pyridyl)-butyric acid; (S)-3-amino-4-(4-trifluoromethylphenyl)-butyric acid; (S)-3-amino-4-pentafluoro-phenylbutyric acid; (S)-3-amino-5-hexenoic acid; (S)-3-amino-5-hexynoic acid; (S)-3-amino-5-phenylpentanoic acid; (S)-3-amino-6-phenyl-5-hexenoic acid; 1,2,5,6-tetrahydropyridine-3-carboxylic acid; 1,2,5,6-tetrahydropyridine-4-carboxylic acid; 3-amino-3-(2-chlorophenyl)-propionic acid; 3-amino-3-(2-thienyl)-propionic acid; 3-amino-3-(3-bromophenyl)-propionic acid; 3-amino-3-(4-chlorophenyl)-propionic acid; 3-amino-3-(4-methoxyphenyl)-propionic acid; 3-amino-4,4,4-trifluoro-butyric acid; 3-aminoadipic acid; D-β-phenylalanine; β-leucine; L-β-homoalanine; L-β-homoaspartic acid γ-benzyl ester; L-β-homoglutamic acid δ-benzyl ester; L-β-homoisoleucine; L-β-homoleucine; L-β-homomethionine; L-β-homophenylalanine; L-β-homoproline; L-β-homotryptophan; L-β-homovaline; L-Nω-benzyloxycarbonyl-β-homolysin; Nω-L-β-homoarginine; O-benzyl-L-β-homohydroxyproline; O-benzyl-L-β-homoserine; O-benzyl-L-β-homothreonine; O-benzyl-L-β-homotyrosine; γ-trityl-L-β-homoasparagine; (R)-β-phenylalanine; L-β-homoaspartic acid γ-t-butyl ester; L-β-homoglutamic acid δ-t-butyl ester; L-Nω-β-homolysine; Nδ-trityl-L-β-homoglutamine; Nω-2,2,4,6,7-pentamethyl-dihydrobenzofuran-5-sulfonyl-L-β-homoarginine; O-t-butyl-L-β-homohydroxy-proline; O-t-butyl-L-β-homoserine; O-t-butyl-L-β-homothreonine; O-t-butyl-L-β-homotyrosine; 2-aminocyclopentane carboxylic acid; and 2-aminocyclohexane carboxylic acid.

Amino acid analogs include analogs of alanine, valine, glycine or leucine. Examples of amino acid analogs of alanine, valine, glycine, and leucine include, but are not limited to, the following: α-methoxyglycine; α-allyl-L-alanine; α-aminoisobutyric acid; α-methyl-leucine; β-(1-naphthyl)-D-alanine; β-(1-naphthyl)-L-alanine; β-(2-naphthyl)-D-alanine; β-(2-naphthyl)-L-alanine; β-(2-pyridyl)-D-alanine; β-(2-pyridyl)-L-alanine; β-(2-thienyl)-D-alanine; β-(2-thienyl)-L-alanine; β-(3-benzothienyl)-D-alanine; β-(3-benzothienyl)-L-alanine; β-(3-pyridyl)-D-alanine; β-(3-pyridyl)-L-alanine; β-(4-pyridyl)-D-alanine; β-(4-pyridyl)-L-alanine; β-chloro-L-alanine; β-cyano-L-alanin; β-cyclohexyl-D-alanine; β-cyclohexyl-L-alanine; β-cyclopenten-1-yl-alanine; β-cyclopentyl-alanine; β-cyclopropyl-L-Ala-OH.dicyclohexylammonium salt; β-t-butyl-D-alanine; β-t-butyl-L-alanine; γ-aminobutyric acid; L-α,β-diaminopropionic acid; 2,4-dinitro-phenylglycine; 2,5-dihydro-D-phenylglycine; 2-amino-4,4,4-trifluorobutyric acid; 2-fluoro-phenylglycine; 3-amino-4,4,4-trifluoro-butyric acid; 3-fluoro-valine; 4,4,4-trifluoro-valine; 4,5-dehydro-L-leu-OH.dicyclohexylammonium salt; 4-fluoro-D-phenylglycine; 4-fluoro-L-phenylglycine; 4-hydroxy-D-phenylglycine; 5,5,5-trifluoro-leucine; 6-aminohexanoic acid; cyclopentyl-D-Gly-OH.dicyclohexylammonium salt; cyclopentyl-Gly-OH.dicyclohexylammonium salt; D-α,β-diaminopropionic acid; D-α-aminobutyric acid; D-α-t-butylglycine; D-(2-thienyl)glycine; D-(3-thienyl)glycine; D-2-aminocaproic acid; D-2-indanylglycine; D-allylglycine.dicyclohexylammonium salt; D-cyclohexylglycine; D-norvaline; D-phenylglycine; β-aminobutyric acid; β-aminoisobutyric acid; (2-bromophenyl)glycine; (2-methoxyphenyl)glycine; (2-methylphenyl)glycine; (2-thiazoyl) glycine; (2-thienyl)glycine; 2-amino-3-(dimethylamino)-propionic acid; L-α,β-diaminopropionic acid; L-α-aminobutyric acid; L-α-t-butylglycine; L-(3-thienyl)glycine; L-2-amino-3-(dimethylamino)-propionic acid; L-2-aminocaproic acid dicyclohexyl-ammonium salt; L-2-indanylglycine; L-allylglycine.dicyclohexyl ammonium salt; L-cyclohexylglycine; L-phenylglycine; L-propargylglycine; L-norvaline; N-α-aminomethyl-L-alanine; D-α,γ-diaminobutyric acid; L-α,γ-diaminobutyric acid; β-cyclopropyl-L-alanine; (N-β-(2,4-dinitrophenyl))-L-α,β-diaminopropionic acid; (N-β-1-(4,4-dimethyl-2,6-dioxocyclohex-1-ylidene) ethyl)-D-α,β-diaminopropionic acid; (N-β-1-(4,4-dimethyl-2,6-dioxocyclohex-1-ylidene)ethyl)-L-α,β-diaminopropionic acid; (N-β-4-methyltrityl)-L-α,β-diaminopropionic acid; (N-β-allyloxycarbonyl)-L-α,β-diaminopropionic acid; (N-γ-1-(4,4-dimethyl-2,6-dioxocyclohex-1-ylidene)ethyl)-D-α,γ-diaminobutyric acid; (N-γ-1-(4,4-dimethyl-2,6-dioxocyclohex-1-ylidene)ethyl)-L-α,γ-diaminobutyric acid; (N-γ-4-methyltrityl)-D-α,γ-diaminobutyric acid; (N-γ-4-methyltrityl)-L-α,γ-diaminobutyric acid; (N-γ-allyloxycarbonyl)-L-α,γ-diaminobutyric acid; D-α,γ-diaminobutyric acid; 4,5-dehydro-L-leucine; cyclopentyl-D-Gly-OH; cyclopentyl-Gly-OH; D-allylglycine; D-homocyclohexylalanine; L-1-pyrenylalanine; L-2-aminocaproic acid; L-allylglycine; L-homocyclohexylalanine; and N-(2-hydroxy-4-methoxy-Bzl)-Gly-OH.

Amino acid analogs further include analogs of arginine or lysine. Examples of amino acid analogs of arginine and lysine include, but are not limited to, the following: citrulline; L-2-amino-3-guanidinopropionic acid; L-2-amino-3-ureidopropionic acid; L-citrulline; Lys(Me)₂-OH; Lys(N₃)—OH; Nδ-benzyloxycarbonyl-L-ornithine; Nω-nitro-D-arginine; Nω-nitro-L-arginine; α-methyl-ornithine; 2,6-diaminoheptanedioic acid; L-ornithine; (Nδ-1-(4,4-dimethyl-2,6-dioxocyclohex-1-ylidene)ethyl)-D-ornithine; (Nδ-1-(4,4-dimethyl-2,6-dioxo-cyclohex-1-ylidene)ethyl)-L-ornithine; (Nδ-4-methyltrityl)-D-ornithine; (Nδ-4-methyltrityl)-L-ornithine; D-ornithine; L-ornithine; Arg(Me)(Pbf)-OH; Arg (Me)₂-OH (asymmetrical); Arg(Me)2-OH (symmetrical); Lys(ivDde)-OH; Lys(Me)2-OH.HCl; Lys(Me3)-OH chloride; Nω-nitro-D-arginine; and Nω-nitro-L-arginine.

Amino acid analogs include analogs of aspartic or glutamic acids. Examples of amino acid analogs of aspartic and glutamic acids include, but are not limited to, the following: α-methyl-D-aspartic acid; α-methyl-glutamic acid; α-methyl-L-aspartic acid; γ-methylene-glutamic acid; (N-γ-ethyl)-L-glutamine; [N-α-(4-aminobenzoyl)]-L-glutamic acid; 2,6-diaminopimelic acid; L-α-aminosuberic acid; D-2-aminoadipic acid; D-α-aminosuberic acid; α-aminopimelic acid; iminodiacetic acid; L-2-aminoadipic acid; threo-β-methyl-aspartic acid; γ-carboxy-D-glutamic acid γ,γ-di-t-butyl ester; γ-carboxy-L-glutamic acid γ,γ-di-t-butyl ester; Glu (OAll)-OH; L-Asu(OtBu)-OH; and pyroglutamic acid.

Amino acid analogs include analogs of cysteine and methionine. Examples of amino acid analogs of cysteine and methionine include, but are not limited to, Cys(farnesyl)-OH, Cys(farnesyl)-OMe, α-methyl-methionine, Cys(2-hydroxyethyl)-OH, Cys(3-aminopropyl)-OH, 2-amino-4-(ethylthio) butyric acid, buthionine, buthioninesulfoximine, ethionine, methionine methylsulfonium chloride, selenomethionine, cysteic acid, [2-(4-pyridyl)ethyl]-DL-penicillamine, [2-(4-pyridyl)ethyl]-L-cysteine, 4-methoxybenzyl-D-penicillamine, 4-methoxybenzyl-L-penicillamine, 4-methylbenzyl-D-penicillamine, 4-methylbenzyl-L-penicillamine, benzyl-D-cysteine, benzyl-L-cysteine, benzyl-DL-homocysteine, carbamoyl-L-cysteine, carboxyethyl-L-cysteine, carboxymethyl-L-cysteine, diphenylmethyl-L-cysteine, ethyl-L-cysteine, methyl-L-cysteine, t-butyl-D-cysteine, trityl-L-homocysteine, trityl-D-penicillamine, cystathionine, homocystine, L-homocystine, (2-aminoethyl)-L-cysteine, seleno-L-cystine, cystathionine, Cys(StBu)-OH, and acetamidomethyl-D-penicillamine Amino acid analogs include analogs of phenylalanine and tyrosine. Examples of amino acid analogs of phenylalanine and tyrosine include β-methyl-phenylalanine, β-hydroxyphenylalanine, α-methyl-3-methoxy-DL-phenylalanine, α-methyl-D-phenylalanine, α-methyl-L-phenylalanine, 1,2,3,4-tetrahydroisoquinoline-3-carboxylic acid, 2,4-dichlorophenylalanine, 2-(trifluoromethyl)-D-phenylalanine, 2-(trifluoromethyl)-L-phenylalanine, 2-bromo-D-phenylalanine, 2-bromo-L-phenylalanine, 2-chloro-D-phenylalanine, 2-chloro-L-phenylalanine, 2-cyano-D-phenylalanine, 2-cyano-L-phenylalanine, 2-fluoro-D-phenylalanine, 2-fluoro-L-phenylalanine, 2-methyl-D-phenylalanine, 2-methyl-L-phenylalanine, 2-nitro-D-phenylalanine, 2-nitro-L-phenylalanine, 2;4;5-trihydroxy-phenylalanine, 3,4,5-trifluoro-D-phenylalanine, 3,4,5-trifluoro-L-phenylalanine, 3,4-dichloro-D-phenylalanine, 3,4-dichloro-L-phenylalanine, 3,4-difluoro-D-phenylalanine, 3,4-difluoro-L-phenylalanine, 3,4-dihydroxy-L-phenylalanine, 3,4-dimethoxy-L-phenylalanine, 3,5,3'-triiodo-L-thyronine, 3,5-diiodo-D-tyrosine, 3,5-diiodo-L-tyrosine, 3,5-diiodo-L-thyronine, 3-(trifluoromethyl)-D-phenylalanine, 3-(trifluoromethyl)-L-phenylalanine, 3-amino-L-tyrosine, 3-bromo-D-phenylalanine, 3-bromo-L-phenylalanine, 3-chloro-D-phenylalanine, 3-chloro-L-phenylalanine, 3-chloro-L-tyrosine, 3-cyano-D-phenylalanine, 3-cyano-L-phenylalanine, 3-fluoro-D-phenylalanine, 3-fluoro-L-phenylalanine, 3-fluoro-tyrosine, 3-iodo-D-phenylalanine, 3-iodo-L-phenylalanine, 3-iodo-L- tyrosine, 3-methoxy-L-tyrosine, 3-methyl-D-phenylalanine, 3-methyl-L-phenylalanine, 3-nitro-D-phenylalanine, 3-nitro-L-phenylalanine, 3-nitro-L-tyrosine, 4-(trifluoromethyl)-D-phenylalanine, 4-(trifluoromethyl)-L-phenylalanine, 4-amino-D-phenylalanine, 4-amino-L-phenylalanine, 4-benzoyl-D-phenylalanine, 4-benzoyl-L-phenylalanine, 4-bis(2-chloroethyl)amino-L-phenylalanine, 4-bromo-D-phenylalanine, 4-bromo-L-phenylalanine, 4-chloro-D-phenylalanine, 4-chloro-L-phenylalanine, 4-cyano-D-phenylalanine, 4-cyano-L-phenylalanine, 4-fluoro-D-phenylalanine, 4-fluoro-L-phenylalanine, 4-iodo-D-phenylalanine, 4-iodo-L-phenylalanine, homophenylalanine, thyroxine, 3,3-diphenylalanine, thyronine, ethyl-tyrosine, and methyl-tyrosine.

Amino acid analogs include analogs of proline. Examples of amino acid analogs of proline include, but are not limited to, 3,4-dehydro-proline, 4-fluoro-proline, cis-4-hydroxy-proline, thiazolidine-2-carboxylic acid, and trans-4-fluoro-proline.

Amino acid analogs include analogs of serine and threonine. Examples of amino acid analogs of serine and threonine include, but are not limited to, 3-amino-2-hydroxy-5-methylhexanoic acid, 2-amino-3-hydroxy-4-methylpentanoic acid, 2-amino-3-ethoxybutanoic acid, 2-amino-3-methoxybutanoic acid, 4-amino-3-hydroxy-6-methylheptanoic acid, 2-amino-3-benzyloxypropionic acid, 2-amino-3-benzyloxypropionic acid, 2-amino-3-ethoxypropionic acid, 4-amino-3-hydroxybutanoic acid, and α-methylserine.

Amino acid analogs include analogs of tryptophan. Examples of amino acid analogs of tryptophan include, but are not limited to, the following: α-methyl-tryptophan; β-(3-benzothienyl)-D-alanine; β-(3-benzothienyl)-L-alanine; 1-methyl-tryptophan; 4-methyl-tryptophan; 5-benzyloxy-tryptophan; 5-bromo-tryptophan; 5-chloro-tryptophan; 5-fluoro-tryptophan; 5-hydroxy-tryptophan; 5-hydroxy-L-tryptophan; 5-methoxy-tryptophan; 5-methoxy-L-tryptophan; 5-methyl-tryptophan; 6-bromo-tryptophan; 6-chloro-D-tryptophan; 6-chloro-tryptophan; 6-fluoro-tryptophan; 6-methyl-tryptophan; 7-benzyloxy-tryptophan; 7-bromo-tryptophan; 7-methyl-1-tryptophan; D-1,2,3,4-tetrahydro-norharman-3-carboxylic acid; 6-methoxy-1,2,3,4-tetrahydronorharman-1-carboxylic acid; 7-azatryptophan; L-1,2,3,4-tetrahydro-norharman-3-carboxylic acid; 5-methoxy-2-methyl-tryptophan; and 6-chloro-L-tryptophan.

In some embodiments, amino acid analogs are racemic. In some embodiments, the D isomer of the amino acid analog is used. In some embodiments, the L isomer of the amino acid analog is used. In other embodiments, the amino acid analog comprises chiral centers that are in the R or S configuration. In still other embodiments, the amino group(s) of a β-amino acid analog is substituted with a protecting group, e.g., tert-butyloxycarbonyl (BOC group), 9-fluorenylmethyloxycarbonyl (FMOC), tosyl, and the like. In yet other embodiments, the carboxylic acid functional group of a β-amino acid analog is protected, e.g., as its ester derivative. In some embodiments the salt of the amino acid analog is used.

A "non-essential" amino acid residue, as used herein, is an amino acid residue present in a wild-type sequence of a polypeptide that can be altered without abolishing or substantially altering essential biological or biochemical activity (e.g., receptor binding or activation) of the polypeptide.

An "essential" amino acid residue, as used herein, is an amino acid residue present in a wild-type sequence of a polypeptide that, when altered, results in abolishing or a substantial reduction in the polypeptide's essential biological or biochemical activity (e.g., receptor binding or activation).

A "conservative amino acid substitution" is one in which an amino acid residue is replaced with a different amino acid residue having a similar side chain. Families of amino acid residues having similar side chains have been defined in the art. These families include amino acids with basic side chains (e.g., K, R, H), acidic side chains (e.g., D, E), uncharged polar side chains (e.g., G, N, Q, S, T, Y, C), nonpolar side chains (e.g., A, V, L, I, P, F, M, W), beta-branched side chains (e.g., T, V, I) and aromatic side chains (e.g., Y, F, W, H). Thus, a predicted nonessential amino acid residue in a polypeptide, for example, is replaced with another amino acid residue from the same side chain family. Other examples of acceptable substitutions are substitutions based on isosteric considerations (e.g. norleucine for methionine) or other properties (e.g. 2-thienylalanine for phenylalanine, or 6-Cl-tryptophan for tryptophan).

The term "capping group" refers to the chemical moiety occurring at either the carboxy or amino terminus of the polypeptide chain of the subject peptidomimetic macrocycle. The capping group of a carboxy terminus includes an unmodified carboxylic acid (i.e. —COOH) or a carboxylic acid with a substituent. For example, the carboxy terminus can be substituted with an amino group to yield a carboxamide at the C-terminus. Various substituents include but are not limited to primary and secondary amines, including pegylated secondary amines. Representative secondary amine capping groups for the C-terminus include:

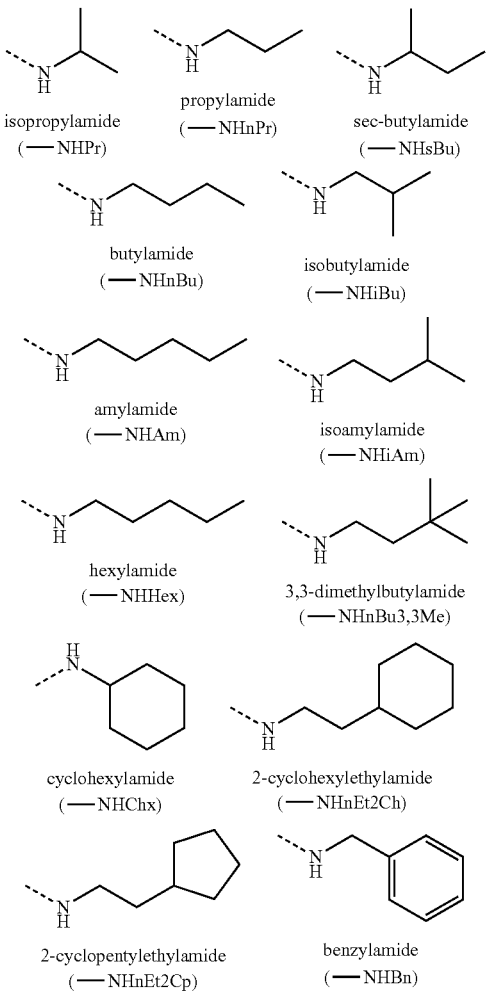

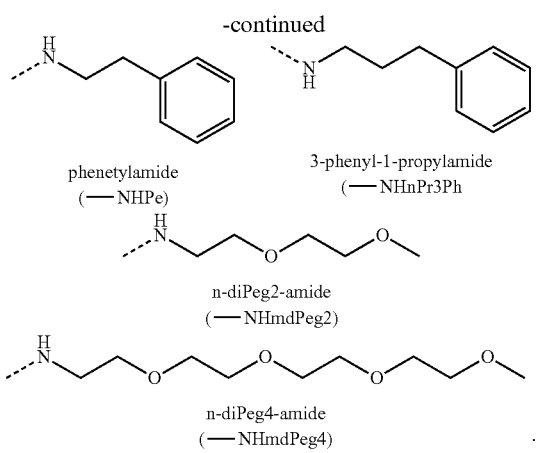

phenetylamide
(—NHPe)

3-phenyl-1-propylamide
(—NHnPr3Ph)

n-diPeg2-amide
(—NHmdPeg2)

n-diPeg4-amide
(—NHmdPeg4)

The capping group of an amino terminus includes an unmodified amine (i.e. —NH$_2$) or an amine with a substituent. For example, the amino terminus can be substituted with an acyl group to yield a carboxamide at the N-terminus Various substituents include but are not limited to substituted acyl groups, including $C_1$-$C_6$ carbonyls, $C_7$-$C_{30}$ carbonyls, and pegylated carbamates. Representative capping groups for the N-terminus include:

considered ten-membered macrocycles as the hydrogen or fluoro substituents or methyl side chains do not participate in forming the macrocycle.

The symbol ⫽ when used as part of a molecular structure refers to a single bond or a trans or cis double bond.

The term "amino acid side chain" refers to a moiety attached to the α-carbon (or another backbone atom) in an amino acid. For example, the amino acid side chain for alanine is methyl, the amino acid side chain for phenylalanine is phenylmethyl, the amino acid side chain for cysteine is thiomethyl, the amino acid side chain for aspartate is carboxymethyl, the amino acid side chain for tyrosine is 4-hydroxyphenylmethyl, etc. Other non-naturally occurring amino acid side chains are also included, for example, those that occur in nature (e.g., an amino acid metabolite) or those that are made synthetically (e.g., an α,α di-substituted amino acid).

The term "α,α di-substituted amino" acid refers to a molecule or moiety containing both an amino group and a carboxyl group bound to a carbon (the α-carbon) that is attached to two natural or non-natural amino acid side chains.

The term "polypeptide" encompasses two or more naturally or non-naturally-occurring amino acids joined by a covalent bond (e.g., an amide bond). Polypeptides as described herein include full length proteins (e.g., fully processed proteins) as well as shorter amino acid sequences (e.g., fragments of naturally-occurring proteins or synthetic polypeptide fragments).

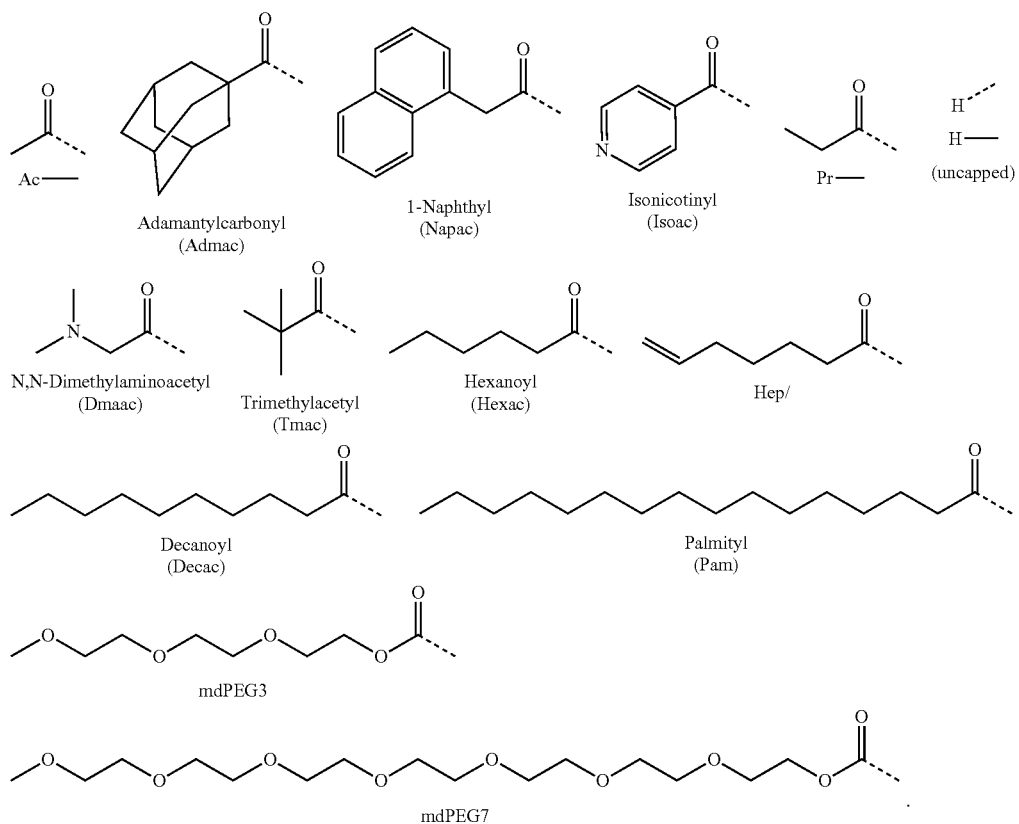

The term "member" as used herein in conjunction with macrocycles or macrocycle-forming linkers refers to the atoms that form or can form the macrocycle, and excludes substituent or side chain atoms. By analogy, cyclodecane, 1,2-difluoro-decane and 1,3-dimethyl cyclodecane are all The term "macrocyclization reagent" or "macrocycle-forming reagent" as used herein refers to any reagent which can be used to prepare a peptidomimetic macrocycle by mediating the reaction between two reactive groups. Reactive groups can be, for example, an azide and alkyne, in which case macrocyclization reagents include, without limitation, Cu reagents such as reagents which provide a reactive Cu(I) species, such as CuBr, CuI or CuOTf, as well as Cu(II) salts such as $Cu(CO_2CH_3)_2$, $CuSO_4$, and $CuCl_2$ that can be converted in situ to an active Cu(I) reagent by the addition of a reducing agent such as ascorbic acid or sodium ascorbate. Macrocyclization reagents can additionally include, for example, Ru reagents known in the art such as Cp*RuCl (PPh$_3$)$_2$, [Cp*RuCl]$_4$ or other Ru reagents which can provide a reactive Ru(II) species. In other cases, the reactive groups are terminal olefins. In such embodiments, the macrocyclization reagents or macrocycle-forming reagents are metathesis catalysts including, but not limited to, stabilized, late transition metal carbene complex catalysts such as Group VIII transition metal carbene catalysts. For example, such catalysts are Ru and Os metal centers having a +2 oxidation state, an electron count of 16 and pentacoordinated. In other examples, catalysts have W or Mo centers. Various catalysts are disclosed in Grubbs et al., "Ring Closing Metathesis and Related Processes in Organic Synthesis" Acc. Chem. Res. 1995, 28, 446-452, U.S. Pat. No. 5,811,515; U.S. Pat. No. 7,932,397; U.S. Application No. 2011/0065915; U.S. Application No. 2011/0245477; Yu et al., "Synthesis of Macrocyclic Natural Products by Catalyst-Controlled Stereoselective Ring-Closing Metathesis," Nature 2011, 479, 88; and Peryshkov et al., "Z-Selective Olefin Metathesis Reactions Promoted by Tungsten Oxo Alkylidene Complexes," J. Am. Chem. Soc. 2011, 133, 20754. In yet other cases, the reactive groups are thiol groups. In such embodiments, the macrocyclization reagent is, for example, a linker functionalized with two thiol-reactive groups such as halogen groups.

The term "halo" or "halogen" refers to fluorine, chlorine, bromine or iodine or a radical thereof.

The term "alkyl" refers to a hydrocarbon chain that is a straight chain or branched chain, containing the indicated number of carbon atoms. For example, $C_1$-$C_{10}$ indicates that the group has from 1 to 10 (inclusive) carbon atoms in it. In the absence of any numerical designation, "alkyl" is a chain (straight or branched) having 1 to 20 (inclusive) carbon atoms in it.

The term "alkylene" refers to a divalent alkyl (i.e., —R—).

The term "alkenyl" refers to a hydrocarbon chain that is a straight chain or branched chain having one or more carbon-carbon double bonds. The alkenyl moiety contains the indicated number of carbon atoms. For example, $C_2$-$C_{10}$ indicates that the group has from 2 to 10 (inclusive) carbon atoms in it. The term "lower alkenyl" refers to a $C_2$-$C_6$ alkenyl chain. In the absence of any numerical designation, "alkenyl" is a chain (straight or branched) having 2 to 20 (inclusive) carbon atoms in it.

The term "alkynyl" refers to a hydrocarbon chain that is a straight chain or branched chain having one or more carbon-carbon triple bonds. The alkynyl moiety contains the indicated number of carbon atoms. For example, $C_2$-$C_{10}$ indicates that the group has from 2 to 10 (inclusive) carbon atoms in it. The term "lower alkynyl" refers to a $C_2$-$C_6$ alkynyl chain. In the absence of any numerical designation, "alkynyl" is a chain (straight or branched) having 2 to 20 (inclusive) carbon atoms in it.

The term "aryl" refers to a 6-carbon monocyclic or 10-carbon bicyclic aromatic ring system wherein 0, 1, 2, 3, or 4 atoms of each ring are substituted by a substituent. Examples of aryl groups include phenyl, naphthyl and the like. The term "arylalkoxy" refers to an alkoxy substituted with aryl.

"Arylalkyl" refers to an aryl group, as defined above, wherein one of the aryl group's hydrogen atoms has been replaced with a $C_1$-$C_5$ alkyl group, as defined above. Representative examples of an arylalkyl group include, but are not limited to, 2-methylphenyl, 3-methylphenyl, 4-methylphenyl, 2-ethylphenyl, 3-ethylphenyl, 4-ethylphenyl, 2-propylphenyl, 3-propylphenyl, 4-propylphenyl, 2-butylphenyl, 3-butylphenyl, 4-butylphenyl, 2-pentylphenyl, 3-pentylphenyl, 4-pentylphenyl, 2-isopropylphenyl, 3-isopropylphenyl, 4-isopropylphenyl, 2-isobutylphenyl, 3-isobutylphenyl, 4-isobutylphenyl, 2-sec-butylphenyl, 3-sec-butylphenyl, 4-sec-butylphenyl, 2-t-butylphenyl, 3-t-butylphenyl and 4-t-butylphenyl.

"Arylamido" refers to an aryl group, as defined above, wherein one of the aryl group's hydrogen atoms has been replaced with one or more —C(O)NH$_2$ groups. Representative examples of an arylamido group include 2-C(O)NH$_2$-phenyl, 3-C(O)NH$_2$-phenyl, 4-C(O)NH$_2$-phenyl, 2-C(O)NH$_2$-pyridyl, 3-C(O)NH$_2$-pyridyl, and 4-C(O)NH$_2$-pyridyl, "Alkylheterocycle" refers to a $C_1$-$C_5$ alkyl group, as defined above, wherein one of the $C_1$-$C_5$ alkyl group's hydrogen atoms has been replaced with a heterocycle. Representative examples of an alkylheterocycle group include, but are not limited to, —CH$_2$CH$_2$-morpholine, —CH$_2$CH$_2$-piperidine, —CH$_2$CH$_2$CH$_2$-morpholine, and —CH$_2$CH$_2$CH$_2$-imidazole.

"Alkylamido" refers to a $C_1$-$C_5$ alkyl group, as defined above, wherein one of the $C_1$-$C_5$ alkyl group's hydrogen atoms has been replaced with a —C(O)NH$_2$ group. Representative examples of an alkylamido group include, but are not limited to, —CH$_2$—C(O)NH$_2$, —CH$_2$CH$_2$—C(O)NH$_2$, —CH$_2$CH$_2$CH$_2$C(O)NH$_2$, —CH$_2$CH$_2$CH$_2$CH$_2$C(O)NH$_2$, —CH$_2$CH$_2$CH$_2$CH$_2$CH$_2$C(O)NH$_2$, —CH$_2$CH(C(O)NH$_2$)CH$_3$, —CH$_2$CH(C(O)NH$_2$)CH$_2$CH$_3$, —CH(C(O)NH$_2$)CH$_2$CH$_3$, —C(CH$_3$)$_2$CH$_2$C(O)NH$_2$, —CH$_2$—CH$_2$—NH—C(O)—CH$_3$, —CH$_2$—CH$_2$—NH—C(O)—CH$_3$—CH3, and —CH$_2$—CH$_2$—NH—C(O)—CH=CH$_2$.

"Alkanol" refers to a $C_1$-$C_5$ alkyl group, as defined above, wherein one of the $C_1$-$C_5$ alkyl group's hydrogen atoms has been replaced with a hydroxyl group. Representative examples of an alkanol group include, but are not limited to, —CH$_2$OH, —CH$_2$CH$_2$OH, —CH$_2$CH$_2$CH$_2$OH, —CH$_2$CH$_2$CH$_2$CH$_2$OH, —CH$_2$CH$_2$CH$_2$CH$_2$CH$_2$OH, —CH$_2$CH(OH)CH$_3$, —CH$_2$CH(OH)CH$_2$CH$_3$, —CH(OH)CH$_3$ and —C(CH$_3$)$_2$CH$_2$OH.

"Alkylcarboxy" refers to a $C_1$-$C_5$ alkyl group, as defined above, wherein one of the $C_1$-$C_5$ alkyl group's hydrogen atoms has been replaced with a –COOH group. Representative examples of an alkylcarboxy group include, but are not limited to, —CH$_2$COOH, —CH$_2$CH$_2$COOH, —CH$_2$CH$_2$CH$_2$COOH, —CH$_2$CH$_2$CH$_2$CH$_2$COOH, —CH$_2$CH(COOH)CH$_3$, —CH$_2$CH$_2$CH$_2$CH$_2$CH$_2$COOH, —CH$_2$CH(COOH)CH$_2$CH$_3$, —CH(COOH)CH$_2$CH$_3$ and —C(CH$_3$)$_2$CH$_2$COOH.

The term "cycloalkyl" as employed herein includes saturated and partially unsaturated cyclic hydrocarbon groups having 3 to 12 carbons, preferably 3 to 8 carbons, and more preferably 3 to 6 carbons, wherein the cycloalkyl group additionally is optionally substituted. Some cycloalkyl groups include, without limitation, cyclopropyl, cyclobutyl, cyclopentyl, cyclopentenyl, cyclohexyl, cyclohexenyl, cycloheptyl, and cyclooctyl.

The term "heteroaryl" refers to an aromatic 5-8 membered monocyclic, 8-12 membered bicyclic, or 11-14 membered tricyclic ring system having 1-3 heteroatoms if monocyclic, 1-6 heteroatoms if bicyclic, or 1-9 heteroatoms if tricyclic, said heteroatoms selected from O, N, or S (e.g., carbon atoms and 1-3, 1-6, or 1-9 heteroatoms of O, N, or S if monocyclic, bicyclic, or tricyclic, respectively), wherein 0, 1, 2, 3, or 4 atoms of each ring are substituted by a substituent. Examples of heteroaryl groups include pyridyl, furyl or furanyl, imidazolyl, benzimidazolyl, pyrimidinyl, thiophenyl or thienyl, quinolinyl, indolyl, thiazolyl, and the like.

The term "heteroarylalkyl" or the term "heteroaralkyl" refers to an alkyl substituted with a heteroaryl. The term "heteroarylalkoxy" refers to an alkoxy substituted with heteroaryl.

The term "heteroarylalkyl" or the term "heteroaralkyl" refers to an alkyl substituted with a heteroaryl. The term "heteroarylalkoxy" refers to an alkoxy substituted with heteroaryl.

The term "heterocyclyl" refers to a nonaromatic 5-8 membered monocyclic, 8-12 membered bicyclic, or 11-14 membered tricyclic ring system having 1-3 heteroatoms if monocyclic, 1-6 heteroatoms if bicyclic, or 1-9 heteroatoms if tricyclic, said heteroatoms selected from O, N, or S (e.g., carbon atoms and 1-3, 1-6, or 1-9 heteroatoms of O, N, or S if monocyclic, bicyclic, or tricyclic, respectively), wherein 0, 1, 2 or 3 atoms of each ring are substituted by a substituent. Examples of heterocyclyl groups include piperazinyl, pyrrolidinyl, dioxanyl, morpholinyl, tetrahydrofuranyl, and the like.

The term "substituent" refers to a group replacing a second atom or group such as a hydrogen atom on any molecule, compound or moiety. Suitable substituents include, without limitation, halo, hydroxy, mercapto, oxo, nitro, haloalkyl, alkyl, alkaryl, aryl, aralkyl, alkoxy, thioalkoxy, aryloxy, amino, alkoxycarbonyl, amido, carboxy, alkanesulfonyl, alkylcarbonyl, and cyano groups.

In some embodiments, one or more compounds disclosed herein contain one or more asymmetric centers and thus occur as racemates and racemic mixtures, single enantiomers, individual diastereomers and diastereomeric mixtures. In one embodiment isomeric forms of these compounds are included in the present invention unless expressly provided otherwise. In some embodiments, one or more compounds disclosed herein are also represented in multiple tautomeric forms, in such instances, the one or more compounds includes all tautomeric forms of the compounds described herein (e.g., if alkylation of a ring system results in alkylation at multiple sites, the one or more compounds includes all such reaction products). All such isomeric forms of such compounds are included in the present invention unless expressly provided otherwise. All crystal forms of the compounds described herein are included in the present invention unless expressly provided otherwise.

As used herein, the terms "increase" and "decrease" mean, respectively, to cause a statistically significantly (i.e., $p<0.1$) increase or decrease of at least 5%.

As used herein, the recitation of a numerical range for a variable is intended to convey that the invention can be practiced with the variable equal to any of the values within that range. Thus, for a variable which is inherently discrete, the variable is equal to any integer value within the numerical range, including the end-points of the range. Similarly, for a variable which is inherently continuous, the variable is equal to any real value within the numerical range, including the end-points of the range. As an example, and without limitation, a variable which is described as having values between 0 and 2 takes the values 0, 1 or 2 if the variable is inherently discrete, and takes the values 0.0, 0.1, 0.01, 0.001, or any other real values $\geq 0$ and $\leq 2$ if the variable is inherently continuous.

As used herein, unless specifically indicated otherwise, the word "or" is used in the inclusive sense of "and/or" and not the exclusive sense of "either/or."

The term "on average" represents the mean value derived from performing at least three independent replicates for each data point.

The term "biological activity" encompasses structural and functional properties of a macrocycle. Biological activity is, for example, structural stability, alpha-helicity, affinity for a target, resistance to proteolytic degradation, cell penetrability, intracellular stability, in vivo stability, or any combination thereof.

The term "binding affinity" refers to the strength of a binding interaction, for example between a peptidomimetic macrocycle and a target. Binding affinity can be expressed, for example, as an equilibrium dissociation constant ("$K_D$"), which is expressed in units which are a measure of concentration (e.g. M, mM, µM, nM etc). Numerically, binding affinity and $K_D$ values vary inversely, such that a lower binding affinity corresponds to a higher $K_D$ value, while a higher binding affinity corresponds to a lower $K_D$ value. Where high binding affinity is desirable, "improved" binding affinity refers to higher binding affinity and therefore lower $K_D$ values.

The term "ratio of binding affinities" refers to the ratio of dissociation constants ($K_D$ values) of a first binding interaction (the numerator), versus a second binding interaction (denominator). Consequently, a "reduced ratio of binding affinities" to Target 1 versus Target 2 refers to a lower value for the ratio expressed as $K_D$(Target 1)/$K_D$(Target 2). This concept can also be characterized as "improved selectivity" for Target 1 versus Target 2, which can be due either to a decrease in the $K_D$ value for Target 1 or an increase in the value for the $K_D$ value for Target 2.

The term "in vitro efficacy" refers to the extent to which a test compound, such as a peptidomimetic macrocycle, produces a beneficial result in an in vitro test system or assay. In vitro efficacy can be measured, for example, as an "$IC_{50}$" or "$EC_{50}$" value, which represents the concentration of the test compound which produces 50% of the maximal effect in the test system.

The term "ratio of in vitro efficacies" or "in vitro efficacy ratio" refers to the ratio of $IC_{50}$ or $EC_{50}$ values from a first assay (the numerator) versus a second assay (the denominator). Consequently, an improved in vitro efficacy ratio for Assay 1 versus Assay 2 refers to a lower value for the ratio expressed as $IC_{50}$(Assay 1)/$IC_{50}$(Assay 2) or alternatively as $EC_{50}$(Assay 1)/$EC_{50}$(Assay 2). This concept can also be characterized as "improved selectivity" in Assay 1 versus Assay 2, which can be due either to a decrease in the $IC_{50}$ or $EC_{50}$ value for Target 1 or an increase in the value for the $IC_{50}$ or $EC_{50}$ value for Target 2.

The details of one or more particular embodiments of the invention are set forth in the accompanying drawings and the description below. Other features, objects, and advantages of the invention will be apparent from the description and drawings, and from the claims.

Peptidomimetic Macrocycles

In some embodiments, a peptidomimetic macrocycle has the Formula (I):

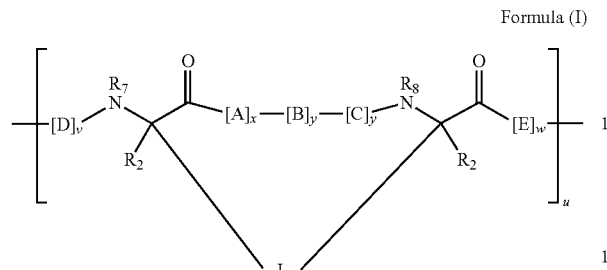

Formula (I)

wherein:
each A, C, D, and E is independently an amino acid;
B is an amino acid,

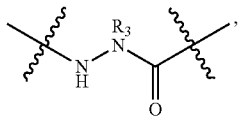

[—NH-L$_3$-CO—], [—NH-L$_3$-SO$_2$—], or [—NH-L$_3$-];
each L and L' is independently a macrocycle-forming linker of the formula

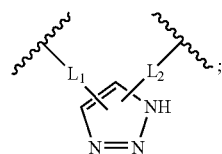

L$_1$, L$_2$ and L$_3$ are independently alkylene, alkenylene, alkynylene, heteroalkylene, cycloalkylene, heterocycloalkylene, cycloarylene, heterocycloarylene, or [—R$_4$—K—R$_4$—]$_n$, each being optionally substituted with R$_5$;

each R$_3$ is independently hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with R$_5$;

each R$_4$ is independently alkylene, alkenylene, alkynylene, heteroalkylene, cycloalkylene, heterocycloalkylene, arylene, or heteroarylene;

each K is independently O, S, SO, SO$_2$, CO, CO$_2$, or CONR$_3$;

each R$_5$ is independently halogen, alkyl, —OR$_6$, —N(R$_6$)$_2$, —SR$_6$, —SOR$_6$, —SO$_2$R$_6$, —CO$_2$R$_6$, a fluorescent moiety, a radioisotope or a therapeutic agent;

each R$_6$ is independently —H, alkyl, alkenyl, alkynyl, arylalkyl, cycloalkylalkyl, heterocycloalkyl, a fluorescent moiety, a radioisotope or a therapeutic agent;

each R$_7$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with R$_5$, or part of a cyclic structure with a D residue;

each R$_8$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with R$_5$, or part of a cyclic structure with an E residue;

v and w are independently integers from 1-1000, for example 1-500, 1-200, 1-100, 1-50, 1-30, 1-20 or 1-10;
u is an integer from 1-10, for example 1-5, 1-3 or 1-2;
x, y and z are independently integers from 0-10, for example the sum of x+y+z is 2, 3, or 6; and
n is an integer from 1-5.

In some embodiments, a peptidomimetic macrocycle has the Formula:

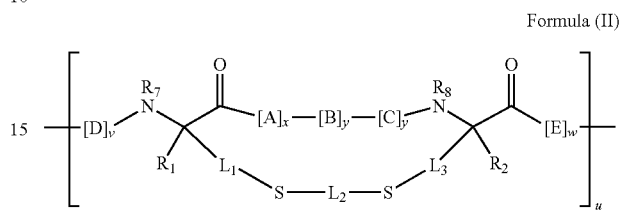

Formula (II)

wherein:
each A, C, D, and E is independently an amino acid;
B is an amino acid,

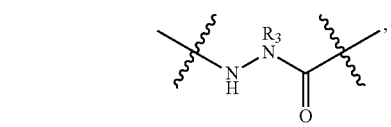

[—NH-L$_4$-CO—], [—NH-L$_4$-SO$_2$—], or [—NH-L$_4$-];

R$_1$ and R$_2$ are independently —H, alkyl, alkenyl, alkynyl, arylalkyl, cycloalkyl, cycloalkylalkyl, heteroalkyl, or heterocycloalkyl, unsubstituted or substituted with halo-; or at least one of R$_1$ and R$_2$ forms a macrocycle-forming linker L' connected to the alpha position of one of said D or E amino acids;

R$_3$ is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with R$_5$;

L$_1$, L$_2$, L$_3$ and L$_4$ are independently alkylene, alkenylene, alkynylene, heteroalkylene, cycloalkylene, heterocycloalkylene, cycloarylene, heterocycloarylene or [—R$_4$—K—R$_4$-]n, each being unsubstituted or substituted with R$_5$;

each K is O, S, SO, SO$_2$, CO, CO$_2$, or CONR$_3$;

each R$_4$ is alkylene, alkenylene, alkynylene, heteroalkylene, cycloalkylene, heterocycloalkylene, arylene, or heteroarylene;

each R$_5$ is independently halogen, alkyl, —OR$_6$, —N(R$_6$)$_2$, —SR$_6$, —SOR$_6$, —SO$_2$R$_6$, —CO$_2$R$_6$, a fluorescent moiety, a radioisotope or a therapeutic agent;

each R$_6$ is independently —H, alkyl, alkenyl, alkynyl, arylalkyl, cycloalkylalkyl, heterocycloalkyl, a fluorescent moiety, a radioisotope or a therapeutic agent;

R$_7$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with R$_5$, or part of a cyclic structure with a D residue;

R$_8$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with R$_5$, or part of a cyclic structure with an E residue;

v and w are independently integers from 1-1000, for example 1-500, 1-200, 1-100, 1-50, 1-30, 1-20 or 1-10;
u is an integer from 1-10, for example 1-5, 1-3 or 1-2;
x, y and z are independently integers from 0-10, for example the sum of x+y+z is 2, 3, or 6; and
n is an integer from 1-5.

In some embodiments, v and w are integers between 1-30. In some embodiments, w is an integer from 3-1000, for example 3-500, 3-200, 3-100, 3-50, 3-30, 3-20, or 3-10.

In some embodiments, the peptidomimetic macrocycles are claimed with the proviso that when u=1 and w=2, the first C-terminal amino acid represented by E is not an Arginine (R) and/or the second C-terminal amino acid represented by E is not a Threonine (T). For instance, when u=1 and w=2, the first C-terminal amino acid and/or the second C-terminal amino acid represented by E do not comprise a positively charged side chain or a polar uncharged side chain. In some embodiments, when u=1 and w=2, the first C-terminal amino acid and/or the second C-terminal amino acid represented by E comprise a hydrophobic side chain. For example, when w=2, the first C-terminal amino acid and/or the second N-terminal amino acid represented by E comprise a hydrophobic side chain, for example a large hydrophobic side chain.

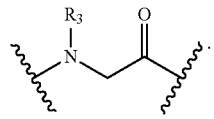

In other embodiments, the length of the macrocycle-forming linker L as measured from a first Cα to a second Cα is selected to stabilize a desired secondary peptide structure, such as an α-helix formed by residues of the peptidomimetic macrocycle including, but not necessarily limited to, those between the first Cα to a second Cα.

Peptidomimetic macrocycles are also provided of the formula:

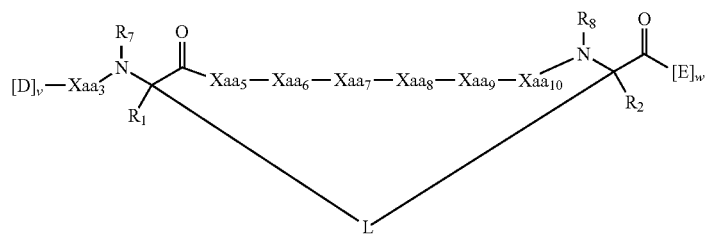

In some embodiments, w is between 3 and 1000. For example, the third amino acid represented by E comprises a large hydrophobic side chain.

In some embodiments of a peptidomimetic macrocycle of Formula I, $L_1$ and $L_2$, either alone or in combination, do not form an all hydrocarbon chain or a thioether. In other embodiments of a peptidomimetic macrocycle of Formula II, $L_1$ and $L_2$, either alone or in combination, do not form an all hydrocarbon chain or a triazole.

In one example, at least one of $R_1$ and $R_2$ is alkyl, unsubstituted or substituted with halo-. In another example, both $R_1$ and $R_2$ are independently alkyl, unsubstituted or substituted with halo-. In some embodiments, at least one of $R_1$ and $R_2$ is methyl. In other embodiments, $R_1$ and $R_2$ are methyl.

In some embodiments, x+y+z is at least 3. In other embodiments, x+y+z is 1, 2, 3, 4, 5, 6, 7, 8, 9 or 10. In some embodiments, the sum of x+y+z is 3 or 6. In some embodiments, the sum of x+y+z is 3. In other embodiments, the sum of x+y+z is 6. Each occurrence of A, B, C, D or E in a macrocycle or macrocycle precursor is independently selected. For example, a sequence represented by the formula $[A]_x$, when x is 3, encompasses embodiments where the amino acids are not identical, e.g. Gln-Asp-Ala as well as embodiments where the amino acids are identical, e.g. Gln-Gln-Gln. This applies for any value of x, y, or z in the indicated ranges. Similarly, when u is greater than 1, each compound can encompass peptidomimetic macrocycles which are the same or different. For example, a compound can comprise peptidomimetic macrocycles comprising different linker lengths or chemical compositions.

In some embodiments, the peptidomimetic macrocycle comprises a secondary structure which is an α-helix and $R_8$ is —H, allowing intrahelical hydrogen bonding. In some embodiments, at least one of A, B, C, D or E is an α,α-disubstituted amino acid. In one example, B is an α,α-disubstituted amino acid. For instance, at least one of A, B, C, D or E is 2-aminoisobutyric acid. In other embodiments, at least one of A, B, C, D or E is wherein:
each of $Xaa_3$, $Xaa_5$, $Xaa_6$, $Xaa_7$, $Xaa_8$, $Xaa_9$, and $Xaa_{10}$ is individually an amino acid, wherein at least three of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$His_5$-$Tyr_6$-$Trp_7$-$Ala_8$-$Gln_9$-$Leu_{10}$-$X_{11}$-$Ser_{12}$ (SEQ ID NO: 1), where each X is an amino acid;

each D and E is independently an amino acid;

$R_1$ and $R_2$ are independently —H, alkyl, alkenyl, alkynyl, arylalkyl, cycloalkyl, cycloalkylalkyl, heteroalkyl, or heterocycloalkyl, unsubstituted or substituted with halo-; or at least one of $R_1$ and $R_2$ forms a macrocycle-forming linker L' connected to the alpha position of one of said D or E amino acids;

each L and L' is independently a macrocycle-forming linker of the formula

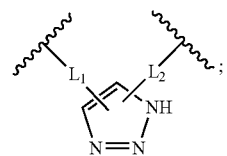

$L_1$ and $L_2$ are independently alkylene, alkenylene, alkynylene, heteroalkylene, cycloalkylene, heterocycloalkylene, cycloarylene, heterocycloarylene, or $[-R_4-K-R_4-]_n$, each being optionally substituted with $R_5$;

each $R_3$ is independently hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;

each $R_4$ is independently alkylene, alkenylene, alkynylene, heteroalkylene, cycloalkylene, heterocycloalkylene, arylene, or heteroarylene;

each K is independently O, S, SO, $SO_2$, CO, $CO_2$, or $CONR_3$;

each $R_5$ is independently halogen, alkyl, —$OR_6$, —$N(R_6)_2$, —$SR_6$, —$SOR_6$, —$SO_2R_6$, —$CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

each $R_7$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;

each $R_8$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

v is an integer from 1-1000, for example 1-500, 1-200, 1-100, 1-50, 1-30, 1-20 or 1-10;

w is an integer from 3-1000, for example 3-500, 3-200, 3-100, 3-50, 3-30, 3-20, or 3-10; and n is an integer from 1-5.

In some embodiments, the peptidomimetic macrocycle has the Formula:

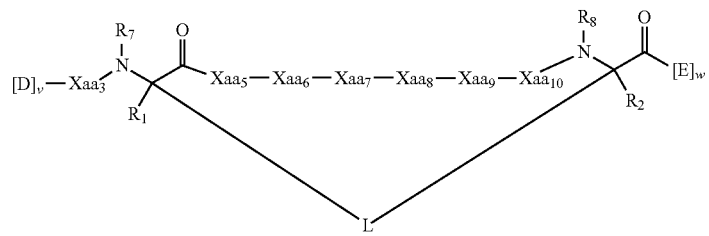

wherein:

each of $Xaa_3$, $Xaa_5$, $Xaa_6$, $Xaa_7$, $Xaa_8$, $Xaa_9$, and $Xaa_{10}$ is individually an amino acid, wherein at least three of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$Glu_5$-$Tyr_6$-$Trp_7$-$Ala_8$-$Gln_9$-$Leu_{10}$/$Cba_{10}$-$X_{11}$-$Ala_{12}$ (SEQ ID NO: 2), where each X is an amino acid;

each D and E is independently an amino acid;

$R_1$ and $R_2$ are independently —H, alkyl, alkenyl, alkynyl, arylalkyl, cycloalkyl, cycloalkylalkyl, heteroalkyl, or heterocycloalkyl, unsubstituted or substituted with halo-; or at least one of $R_1$ and $R_2$ forms a macrocycle-forming linker L' connected to the alpha position of one of said D or E amino acids;

each L and L' is independently a macrocycle-forming linker of the formula

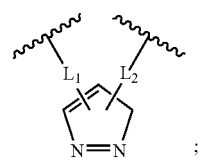

$L_1$ and $L_2$ are independently alkylene, alkenylene, alkynylene, heteroalkylene, cycloalkylene, heterocycloalkylene, cycloarylene, heterocycloarylene, or [—$R_4$—K—$R_4$—]$_n$, each being optionally substituted with $R_5$;

$R_3$ is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;

each $R_4$ is alkylene, alkenylene, alkynylene, heteroalkylene, cycloalkylene, heterocycloalkylene, arylene, or heteroarylene;

each K is O, S, SO, $SO_2$, CO, $CO_2$, or $CONR_3$;

each $R_5$ is independently halogen, alkyl, —$OR_6$, —$N(R_6)_2$, —$SR_6$, —$SOR_6$, —$SO_2R_6$, —$CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

$R_7$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;

$R_8$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

v is an integer from 1-1000, for example 1-500, 1-200, 1-100, 1-50, 1-30, 1-20, or 1-10;

w is an integer from 3-1000, for example 3-500, 3-200, 3-100, 3-50, 3-30, 3-20, or 3-10; and n is an integer from 1-5.

Peptidomimetic macrocycles are also provided of the formula:

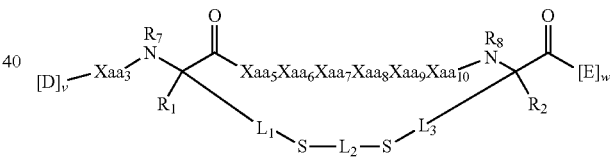

wherein:

each of $Xaa_3$, $Xaa_5$, $Xaa_6$, $Xaa_7$, $Xaa_8$, $Xaa_9$, and $Xaa_{10}$ is individually an amino acid, wherein at least three of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$His_5$-$Tyr_6$-$Trp_7$-$Ala_8$-$Gln_9$-$Leu_{10}$-$X_{11}$-$Ser_{12}$ (SEQ ID NO: 1), where each X is an amino acid;

each D and E is independently an amino acid;

$R_1$ and $R_2$ are independently —H, alkyl, alkenyl, alkynyl, arylalkyl, cycloalkyl, cycloalkylalkyl, heteroalkyl, or heterocycloalkyl, unsubstituted or substituted with halo-; or at least one of $R_1$ and $R_2$ forms a macrocycle-forming linker L' connected to the alpha position of one of said D or E amino acids;

$L_1$, $L_2$, $L_3$ and $L_4$ are independently alkylene, alkenylene, alkynylene, heteroalkylene, cycloalkylene, heterocycloalkylene, cycloarylene, heterocycloarylene or [—$R_4$—K—$R_4$-]n, each being unsubstituted or substituted with $R_5$;

each K is O, S, SO, $SO_2$, CO, $CO_2$, or $CONR_3$;

$R_3$ is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;

each $R_4$ is alkylene, alkenylene, alkynylene, heteroalkylene, cycloalkylene, heterocycloalkylene, arylene, or heteroarylene;

each $R_5$ is independently halogen, alkyl, —$OR_6$, —$N(R_6)_2$, —$SR_6$, —$SOR_6$, —$SO_2R_6$, —$CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

$R_7$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;

$R_8$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

v is an integer from 1-1000, for example 1-500, 1-200, 1-100, 1-50, 1-30, 1-20 or 1-10;

w is an integer from 3-1000, for example 3-500, 3-200, 3-100, 3-50, 3-30, 3-20, or 3-10; and n is an integer from 1-5.

Peptidomimetic macrocycles are also provided of the formula:

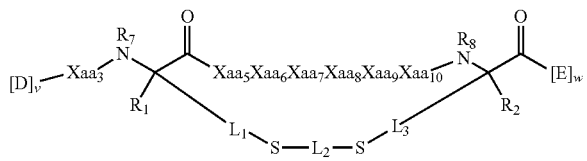

wherein:

each of $Xaa_3$, $Xaa_5$, $Xaa_6$, $Xaa_7$, $Xaa_8$, $Xaa_9$, and $Xaa_{10}$ is individually an amino acid, wherein at least three of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$Glu_5$-$Tyr_6$-$Trp_7$-$Ala_8$-$Gln_9$-$Leu_{10}$/$Cba_{10}$-$X_{11}$-$Ala_{12}$ (SEQ ID NO: 2), where each X is an amino acid;

each D and E is independently an amino acid;

$R_1$ and $R_2$ are independently —H, alkyl, alkenyl, alkynyl, arylalkyl, cycloalkyl, cycloalkylalkyl, heteroalkyl, or heterocycloalkyl, unsubstituted or substituted with halo-; or at least one of $R_1$ and $R_2$ forms a macrocycle-forming linker L' connected to the alpha position of one of said D or E amino acids;

$L_1$, $L_2$, $L_3$ and $L_4$ are independently alkylene, alkenylene, alkynylene, heteroalkylene, cycloalkylene, heterocycloalkylene, cycloarylene, heterocycloarylene or [—$R_4$—K—$R_4$—]n, each being unsubstituted or substituted with $R_5$;

each K is O, S, SO, $SO_2$, CO, $CO_2$, or $CONR_3$;

$R_3$ is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;

each $R_4$ is alkylene, alkenylene, alkynylene, heteroalkylene, cycloalkylene, heterocycloalkylene, arylene, or heteroarylene;

each $R_5$ is independently halogen, alkyl, —$OR_6$, —$N(R_6)_2$, —$SR_6$, —$SOR_6$, —$SO_2R_6$, —$CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

$R_7$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;

$R_8$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

v is an integer from 1-1000, for example 1-500, 1-200, 1-100, 1-50, 1-30, 1-20, or 1-10;

w is an integer from 3-1000, for example 3-500, 3-200, 3-100, 3-50, 3-30, 3-20, or 3-10; and n is an integer from 1-5.

In one embodiment, the peptidomimetic macrocycle is:

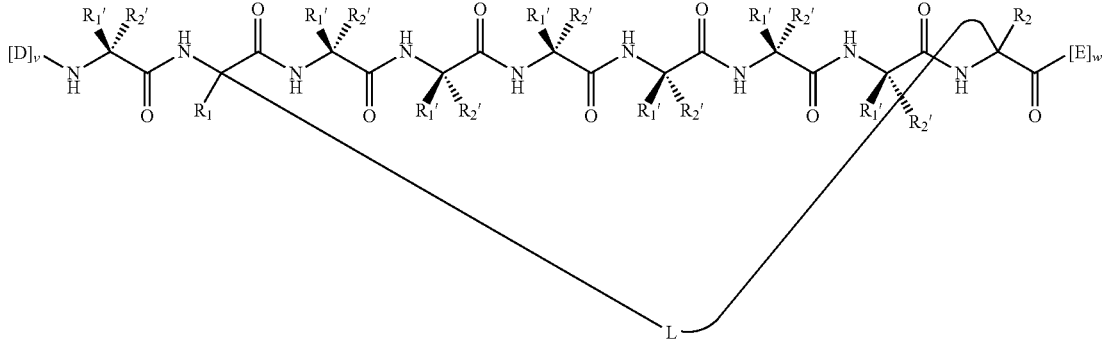

wherein each $R_1$ and $R_2$ is —H, alkyl, alkenyl, alkynyl, arylalkyl, cycloalkyl, cycloalkylalkyl, heteroalkyl, or heterocycloalkyl, unsubstituted or substituted with halo-.

In related embodiments, the peptidomimetic macrocycle is:
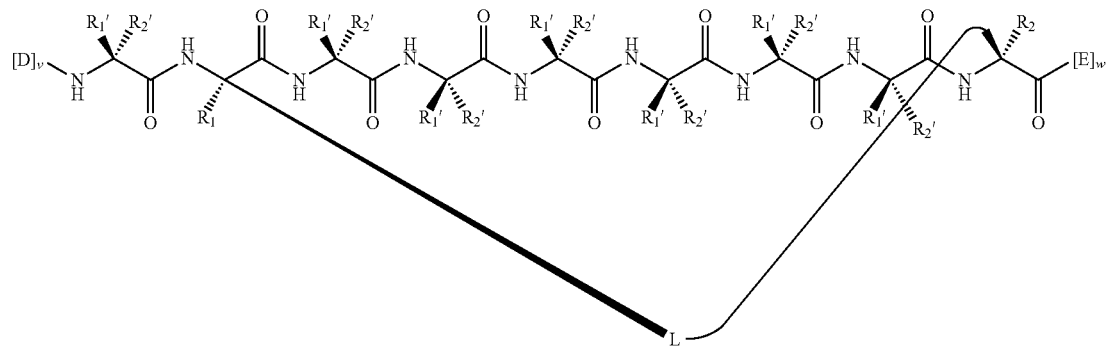
wherein each $R_1'$ and $R_2'$ is independently an amino acid.
In other embodiments, the peptidomimetic macrocycle is a compound of any of the formulas shown below:
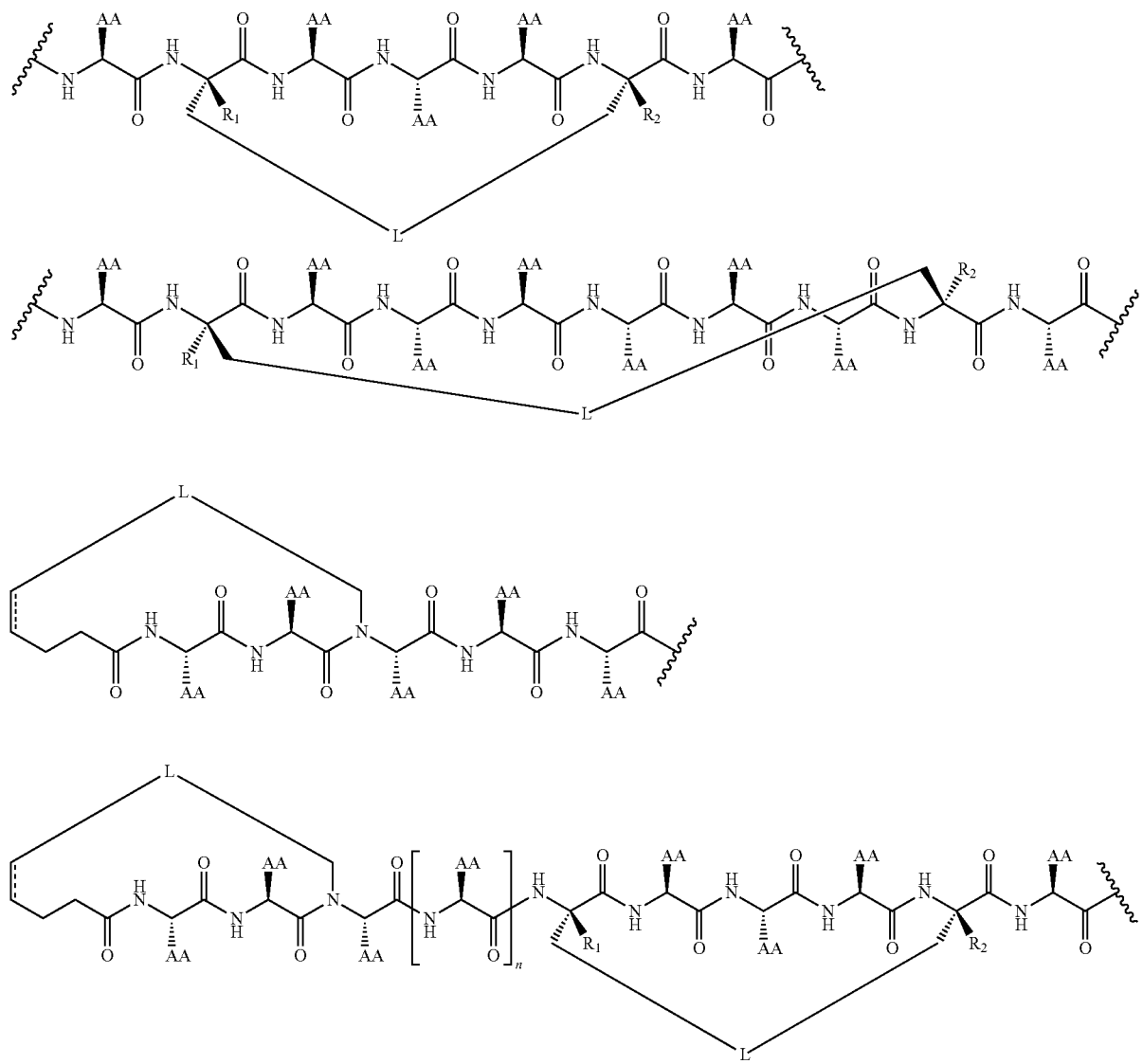

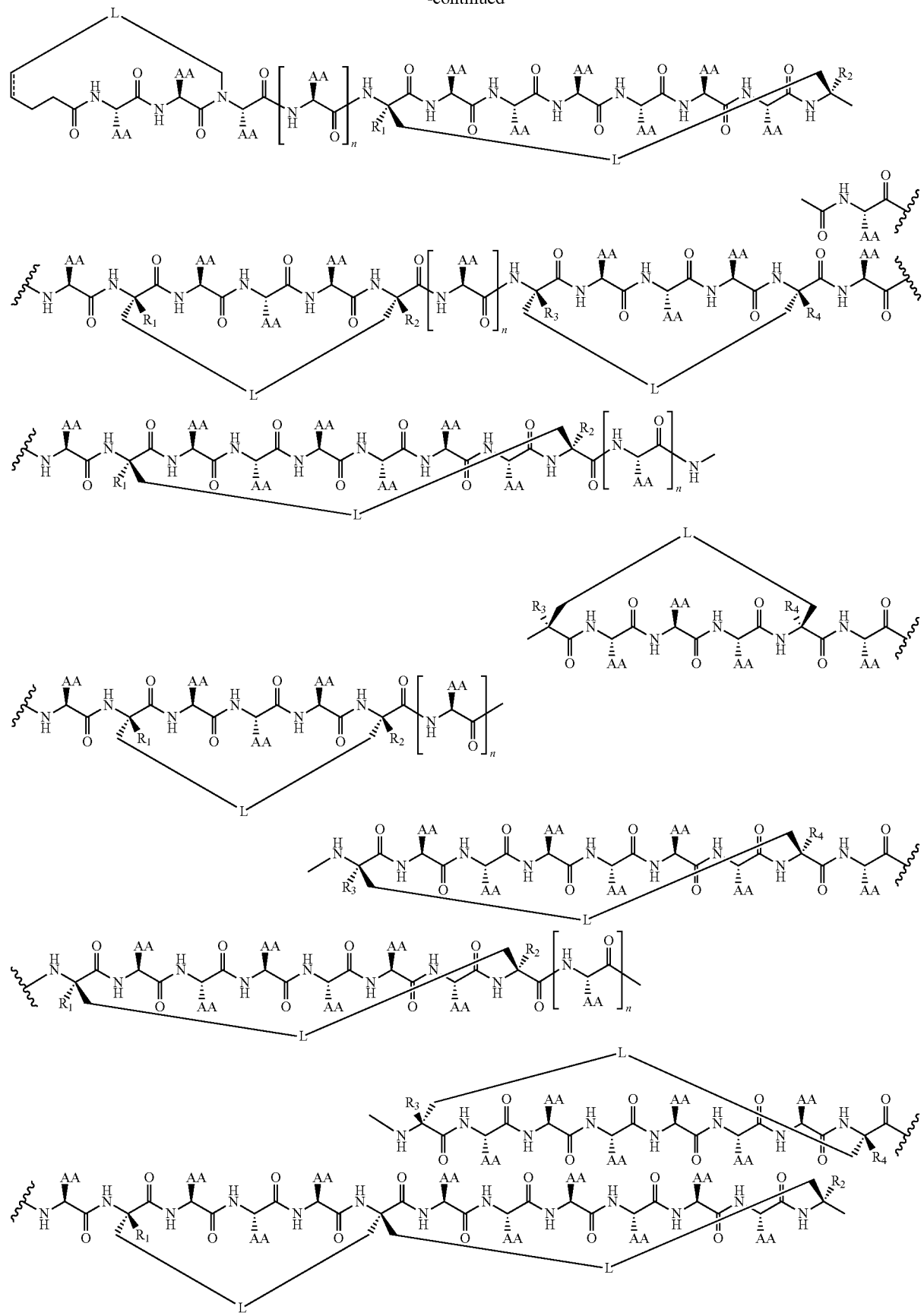

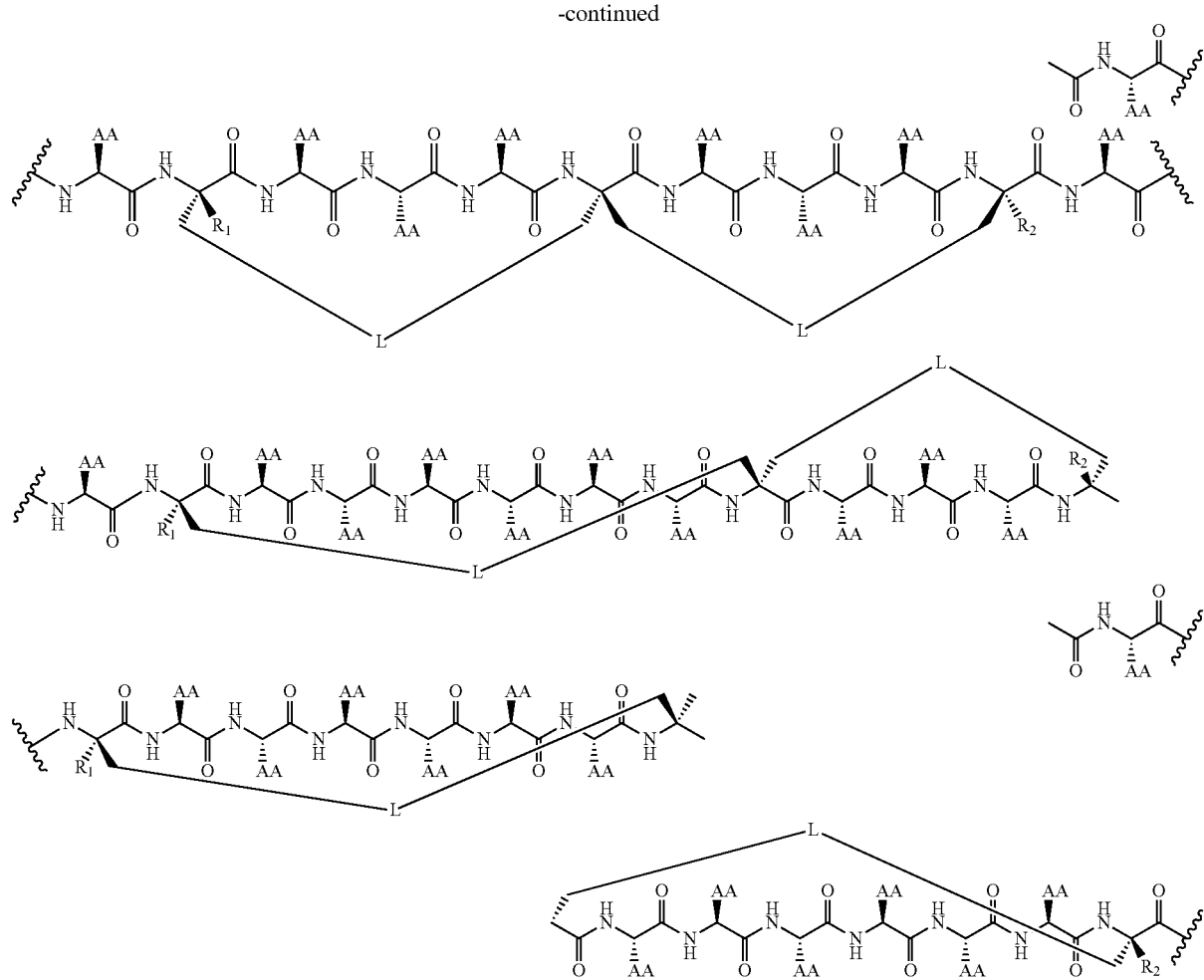
wherein "AA" represents any natural or non-natural amino acid side chain and ⌇ is $[D]_v$, $[E]_w$ as defined above, and n is an integer between 0 and 20, 50, 100, 200, 300, 400 or 500. In some embodiments, n is 0. In other embodiments, n is less than 50.
Exemplary embodiments of the macrocycle-forming linker L for peptidomimetic macrocycles of Formula I are shown below.
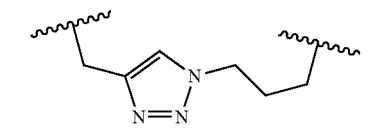
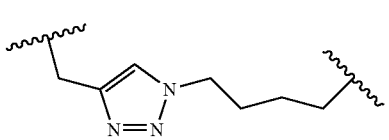
-continued
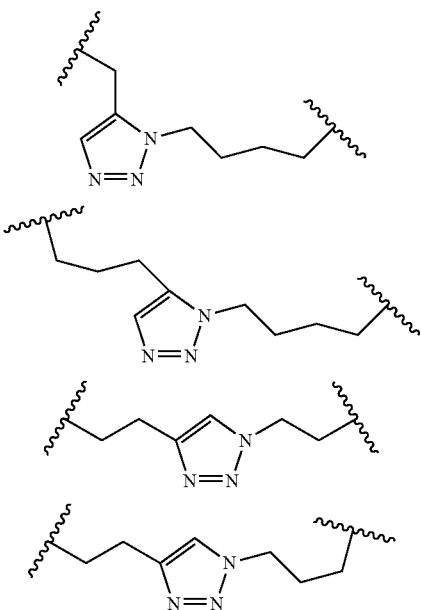

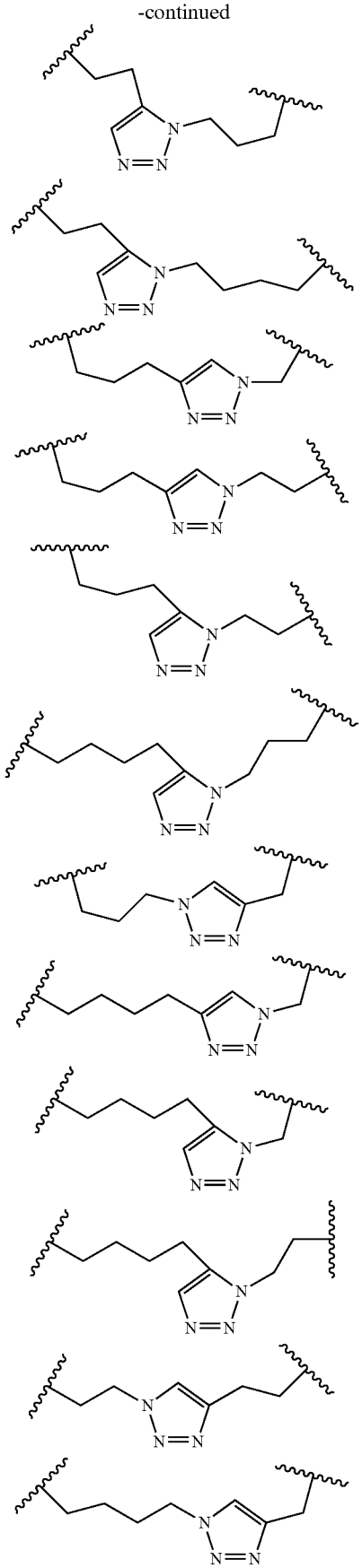
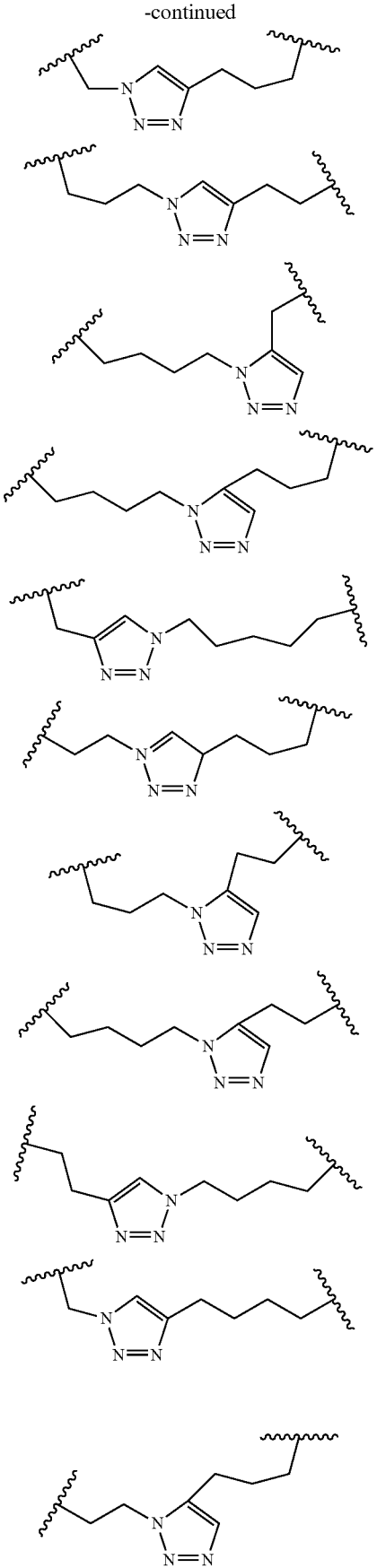

49
-continued
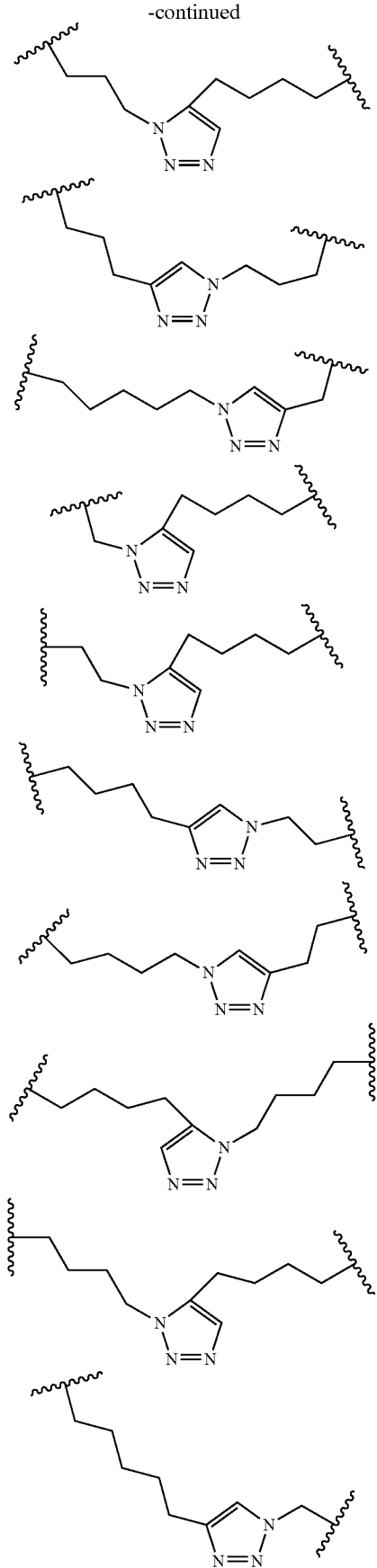
50
-continued
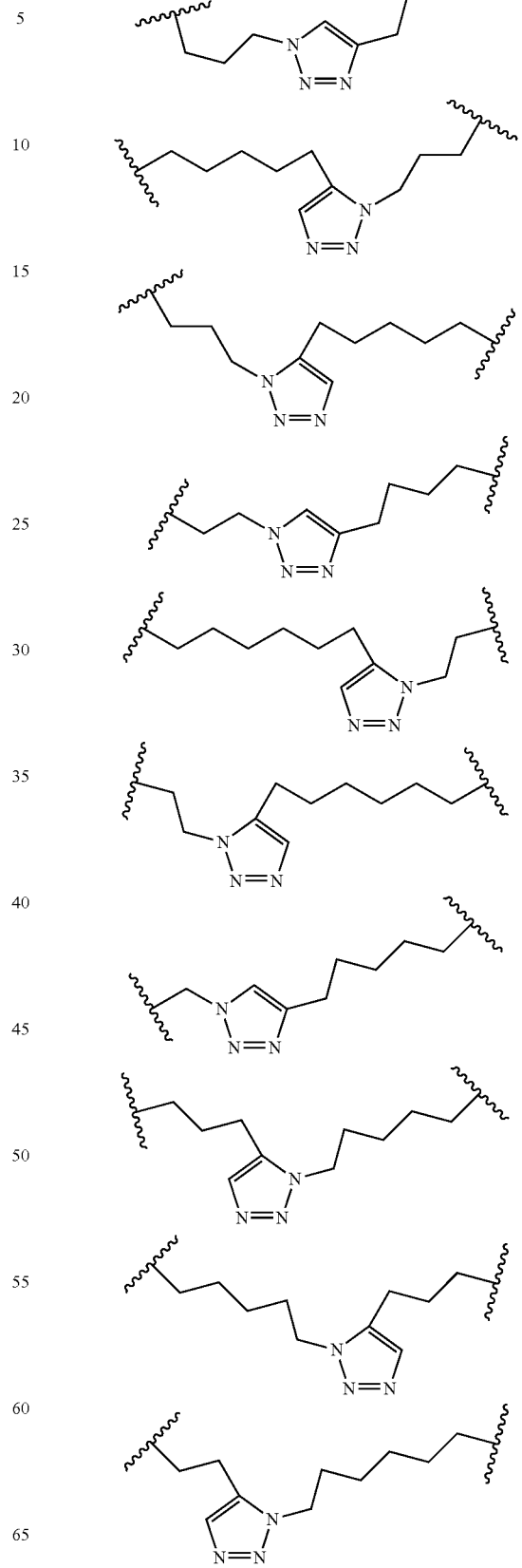

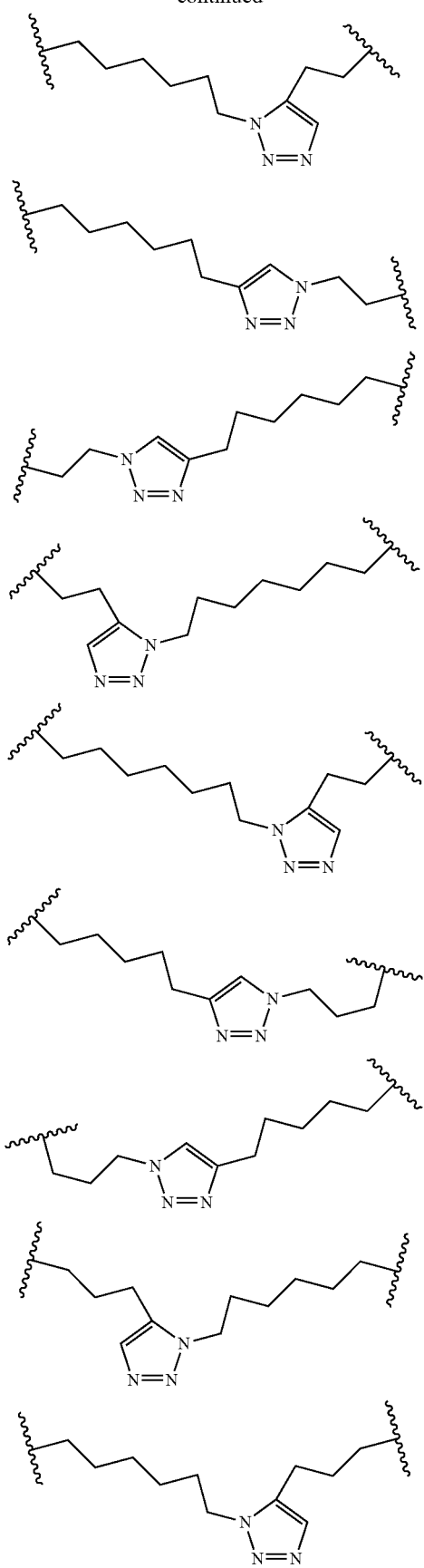
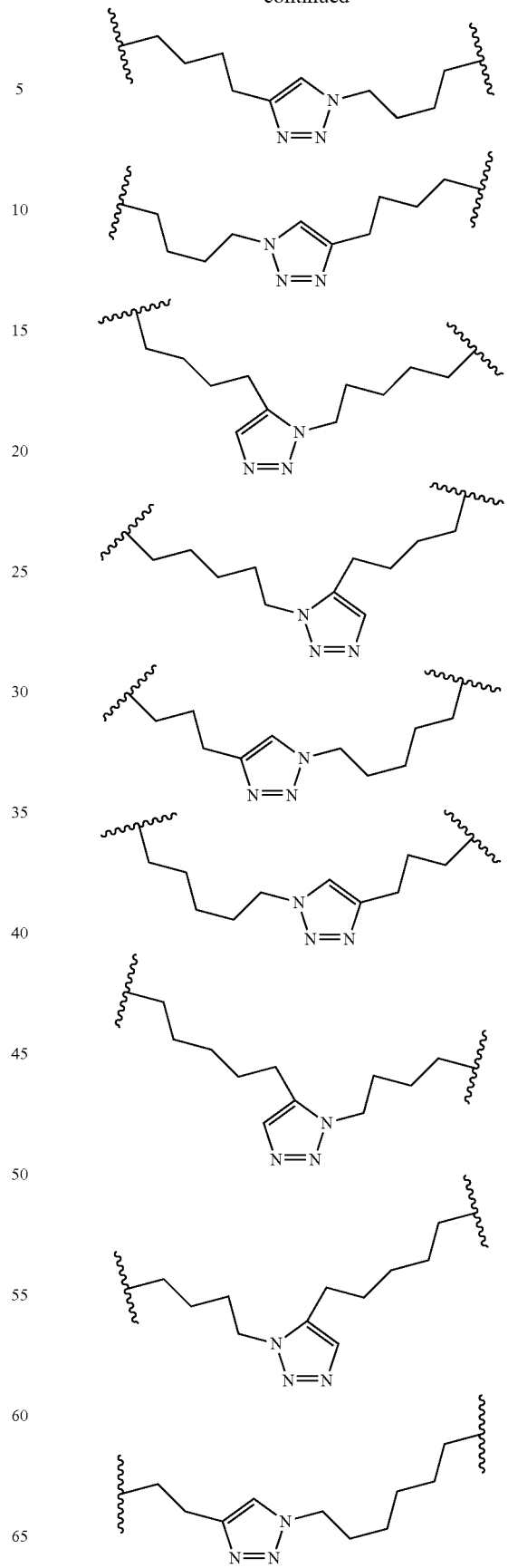

53
-continued
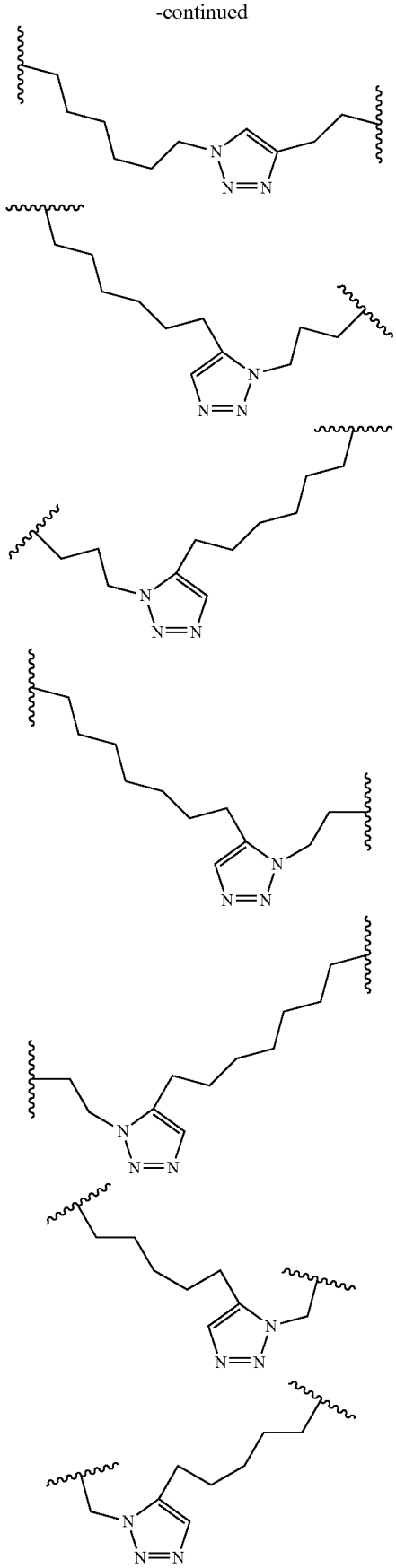
54
-continued
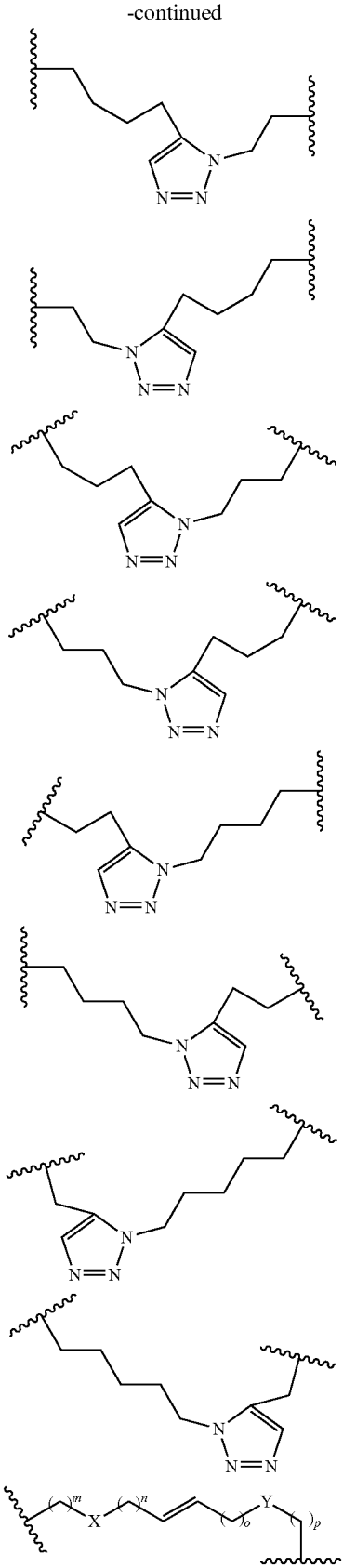
where X, Y = S
m, n, o, p = 0-10

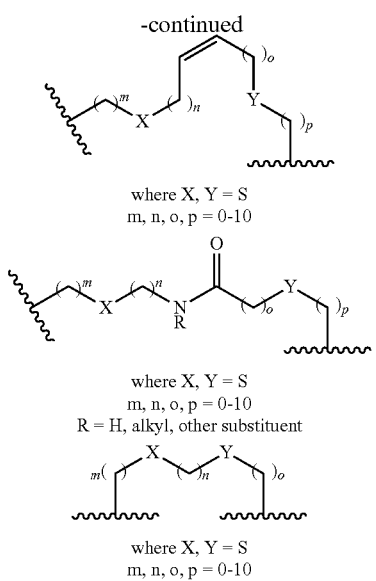

where X, Y = S
m, n, o, p = 0-10 where X, Y = S
m, n, o, p = 0-10
R = H, alkyl, other substituent where X, Y = S
m, n, o, p = 0-10

In other embodiments, D and/or E in a compound of Formula I or II are further modified in order to facilitate cellular uptake. In some embodiments, lipidating or PEGylating a peptidomimetic macrocycle facilitates cellular uptake, increases bioavailability, increases blood circulation, alters pharmacokinetics, decreases immunogenicity and/or decreases the needed frequency of administration.

In other embodiments, at least one of [D] and [E] in a compound of Formula I or II represents a moiety comprising an additional macrocycle-forming linker such that the peptidomimetic macrocycle comprises at least two macrocycle-forming linkers. In a specific embodiment, a peptidomimetic macrocycle comprises two macrocycle-forming linkers. In an embodiment, u is 2.

In some embodiments, any of the macrocycle-forming linkers described herein can be used in any combination with any of the sequences shown in Tables 4, 4a, 4b, 6, and 6a and also with any of the R-substituents indicated herein.

In some embodiments, the peptidomimetic macrocycle comprises at least one α-helix motif. For example, A, B and/or C in a compound of Formula I or II include one or more α-helices. As a general matter, α-helices include between 3 and 4 amino acid residues per turn. In some embodiments, the α-helix of the peptidomimetic macrocycle includes 1 to 5 turns and, therefore, 3 to 20 amino acid residues. In specific embodiments, the α-helix includes 1 turn, 2 turns, 3 turns, 4 turns, or 5 turns. In some embodiments, the macrocycle-forming linker stabilizes an α-helix motif included within the peptidomimetic macrocycle. Thus, in some embodiments, the length of the macrocycle-forming linker L from a first Cα to a second Cα is selected to increase the stability of an α-helix. In some embodiments, the macrocycle-forming linker spans from 1 turn to 5 turns of the α-helix. In some embodiments, the macrocycle-forming linker spans approximately 1 turn, 2 turns, 3 turns, 4 turns, or 5 turns of the α-helix. In some embodiments, the length of the macrocycle-forming linker is approximately 5 Å to 9 Å per turn of the α-helix, or approximately 6 Å to 8 Å per turn of the α-helix. Where the macrocycle-forming linker spans approximately 1 turn of an α-helix, the length is equal to approximately 5 carbon-carbon bonds to 13 carbon-carbon bonds, approximately 7 carbon-carbon bonds to 11 carbon-carbon bonds, or approximately 9 carbon-carbon bonds. Where the macrocycle-forming linker spans approximately 2 turns of an α-helix, the length is equal to approximately 8 carbon-carbon bonds to 16 carbon-carbon bonds, approximately 10 carbon-carbon bonds to 14 carbon-carbon bonds, or approximately 12 carbon-carbon bonds. Where the macrocycle-forming linker spans approximately 3 turns of an α-helix, the length is equal to approximately 14 carbon-carbon bonds to 22 carbon-carbon bonds, approximately 16 carbon-carbon bonds to 20 carbon-carbon bonds, or approximately 18 carbon-carbon bonds. Where the macrocycle-forming linker spans approximately 4 turns of an α-helix, the length is equal to approximately 20 carbon-carbon bonds to 28 carbon-carbon bonds, approximately 22 carbon-carbon bonds to 26 carbon-carbon bonds, or approximately 24 carbon-carbon bonds. Where the macrocycle-forming linker spans approximately 5 turns of an α-helix, the length is equal to approximately 26 carbon-carbon bonds to 34 carbon-carbon bonds, approximately 28 carbon-carbon bonds to 32 carbon-carbon bonds, or approximately 30 carbon-carbon bonds. Where the macrocycle-forming linker spans approximately 1 turn of an α-helix, the linkage contains approximately 4 atoms to 12 atoms, approximately 6 atoms to 10 atoms, or approximately 8 atoms. Where the macrocycle-forming linker spans approximately 2 turns of the α-helix, the linkage contains approximately 7 atoms to 15 atoms, approximately 9 atoms to 13 atoms, or approximately 11 atoms. Where the macrocycle-forming linker spans approximately 3 turns of the α-helix, the linkage contains approximately 13 atoms to 21 atoms, approximately 15 atoms to 19 atoms, or approximately 17 atoms. Where the macrocycle-forming linker spans approximately 4 turns of the α-helix, the linkage contains approximately 19 atoms to 27 atoms, approximately 21 atoms to 25 atoms, or approximately 23 atoms. Where the macrocycle-forming linker spans approximately 5 turns of the α-helix, the linkage contains approximately 25 atoms to 33 atoms, approximately 27 atoms to 31 atoms, or approximately 29 atoms. Where the macrocycle-forming linker spans approximately 1 turn of the α-helix, the resulting macrocycle forms a ring containing approximately 17 members to 25 members, approximately 19 members to 23 members, or approximately 21 members. Where the macrocycle-forming linker spans approximately 2 turns of the α-helix, the resulting macrocycle forms a ring containing approximately 29 members to 37 members, approximately 31 members to 35 members, or approximately 33 members. Where the macrocycle-forming linker spans approximately 3 turns of the α-helix, the resulting macrocycle forms a ring containing approximately 44 members to 52 members, approximately 46 members to 50 members, or approximately 48 members. Where the macrocycle-forming linker spans approximately 4 turns of the α-helix, the resulting macrocycle forms a ring containing approximately 59 members to 67 members, approximately 61 members to 65 members, or approximately 63 members. Where the macrocycle-forming linker spans approximately 5 turns of the α-helix, the resulting macrocycle forms a ring containing approximately 74 members to 82 members, approximately 76 members to 80 members, or approximately 78 members.

Unless otherwise stated, any compounds (including peptidomimetic macrocycles, macrocycle precursors, and other compositions) are also meant to encompass compounds which differ only in the presence of one or more isotopically enriched atoms. For example, compounds having the described structures except for the replacement of a hydrogen by a deuterium or tritium, or the replacement of a carbon by $^{13}C$- or $^{14}C$-enriched carbon are contemplated herein.

In some embodiments, the peptidomimetic macrocycle has improved binding affinity to MDM2 or MDMX relative to a corresponding peptidomimetic macrocycle where w is 0, 1 or 2. In other instances, the peptidomimetic macrocycle has a reduced ratio of binding affinities to MDMX versus MDM2 relative to a corresponding peptidomimetic macrocycle where w is 0, 1 or 2. In still other instances, the peptidomimetic macrocycle has improved in vitro anti-tumor efficacy against p53 positive tumor cell lines relative to a corresponding peptidomimetic macrocycle where w is 0, 1 or 2. In some embodiments, the peptidomimetic macrocycle shows improved in vitro induction of apoptosis in p53 positive tumor cell lines relative to a corresponding peptidomimetic macrocycle where w is 0, 1 or 2. In other instances, the peptidomimetic macrocycle of claim 1, wherein the peptidomimetic macrocycle has an improved in vitro anti-tumor efficacy ratio for p53 positive versus p53 negative or mutant tumor cell lines relative to a corresponding peptidomimetic macrocycle where w is 0, 1 or 2. In still other instances, the peptidomimetic macrocycle has improved in vivo anti-tumor efficacy against p53 positive tumors relative to a corresponding peptidomimetic macrocycle where w is 0, 1 or 2. In yet other instances, the peptidomimetic macrocycle has improved in vivo induction of apoptosis in p53 positive tumors relative to a corresponding peptidomimetic macrocycle where w is 0, 1 or 2. In some embodiments, the peptidomimetic macrocycle has improved cell permeability relative to a corresponding peptidomimetic macrocycle where w is 0, 1 or 2. In other cases, the peptidomimetic macrocycle has improved solubility relative to a corresponding peptidomimetic macrocycle where w is 0, 1 or 2.

In some embodiments, $Xaa_5$ is Glu or an amino acid analog thereof. In some embodiments, $Xaa_5$ is Glu or an amino acid analog thereof and wherein the peptidomimetic macrocycle has an improved property, such as improved binding affinity, improved solubility, improved cellular efficacy, improved cell permeability, improved in vivo or in vitro anti-tumor efficacy, or improved induction of apoptosis relative to a corresponding peptidomimetic macrocycle where $Xaa_5$ is Ala.

In some embodiments, the peptidomimetic macrocycle has improved binding affinity to MDM2 or MDMX relative to a corresponding peptidomimetic macrocycle where $Xaa_5$ is Ala. In other embodiments, the peptidomimetic macrocycle has a reduced ratio of binding affinities to MDMX vs MDM2 relative to a corresponding peptidomimetic macrocycle where $Xaa_5$ is Ala. In some embodiments, the peptidomimetic macrocycle has improved solubility relative to a corresponding peptidomimetic macrocycle where $Xaa_5$ is Ala, or the peptidomimetic macrocycle has improved cellular efficacy relative to a corresponding peptidomimetic macrocycle where $Xaa_5$ is Ala.

In some embodiments, $Xaa_5$ is Glu or an amino acid analog thereof and wherein the peptidomimetic macrocycle has improved biological activity, such as improved binding affinity, improved solubility, improved cellular efficacy, improved helicity, improved cell permeability, improved in vivo or in vitro anti-tumor efficacy, or improved induction of apoptosis relative to a corresponding peptidomimetic macrocycle where $Xaa_5$ is Ala.

In one embodiment, a compound disclosed herein can contain unnatural proportions of atomic isotopes at one or more of atoms that constitute such compounds. For example, the compounds can be radiolabeled with radioactive isotopes, such as for example tritium ($^3H$), iodine-125 ($^{125}I$) or carbon-14 ($^{14}C$). In another embodiment, a compound disclosed herein can have one or more carbon atoms replaced with a silicon atom. All isotopic variations of the compounds disclosed herein, whether radioactive or not, are contemplated herein.

Preparation of Peptidomimetic Macrocycles

Peptidomimetic macrocycles of Formulas I and II can be prepared by any of a variety of methods known in the art. For example, macrocycles of Formula I having residues indicated by "$4rn6$" or "$4a5$" in Table 4, Table 4a or Table 4b can be substituted with a residue capable of forming a crosslinker with a second residue in the same molecule or a precursor of such a residue.

In some embodiments, the synthesis of these peptidomimetic macrocycles involves a multi-step process that features the synthesis of a peptidomimetic precursor containing an azide moiety and an alkyne moiety; followed by contacting the peptidomimetic precursor with a macrocyclization reagent to generate a triazole-linked peptidomimetic macrocycle. Such a process is described, for example, in U.S. application Ser. No. 12/037,041, filed on Feb. 25, 2008. Macrocycles or macrocycle precursors are synthesized, for example, by solution phase or solid-phase methods, and can contain both naturally-occurring and non-naturally-occurring amino acids. See, for example, Hunt, "The Non-Protein Amino Acids" in *Chemistry and Biochemistry of the Amino Acids*, edited by G. C. Barrett, Chapman and Hall, 1985.

In some embodiments of macrocycles of Formula I, an azide is linked to the α-carbon of a residue and an alkyne is attached to the α-carbon of another residue. In some embodiments, the azide moieties are azido-analogs of amino acids L-lysine, D-lysine, alpha-methyl-L-lysine, alpha-methyl-D-lysine, L-ornithine, D-ornithine, alpha-methyl-L-ornithine or alpha-methyl-D-ornithine. In another embodiment, the alkyne moiety is L-propargylglycine. In yet other embodiments, the alkyne moiety is an amino acid selected from the group consisting of L-propargylglycine, D-propargylglycine, (S)-2-amino-2-methyl-4-pentynoic acid, (R)-2-amino-2-methyl-4-pentynoic acid, (S)-2-amino-2-methyl-5-hexynoic acid, (R)-2-amino-2-methyl-5-hexynoic acid, (S)-2-amino-2-methyl-6-heptynoic acid, (R)-2-amino-2-methyl-6-heptynoic acid, (S)-2-amino-2-methyl-7-octynoic acid, (R)-2-amino-2-methyl-7-octynoic acid, (S)-2-amino-2-methyl-8-nonynoic acid and (R)-2-amino-2-methyl-8-nonynoic acid.

In some embodiments, provided herein is a method for synthesizing a peptidomimetic macrocycle of Formula I, the method comprising the steps of contacting a peptidomimetic precursor of formulas:

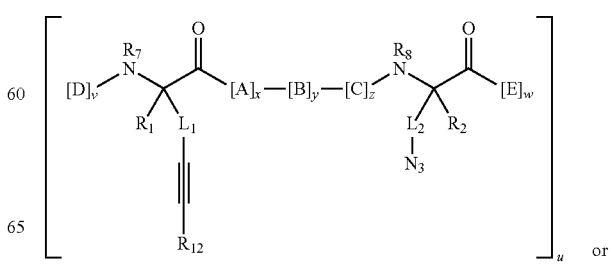

or

-continued

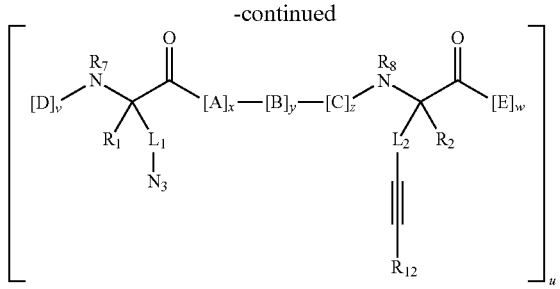

with a macrocyclization reagent;

wherein v, w, x, y, z, A, B, C, D, E, $R_1$, $R_2$, $R_7$, $R_8$, $L_1$ and $L_2$ are as defined above; $R_{12}$ is —H when the macrocyclization reagent is a Cu reagent and $R_{12}$ is —H or alkyl when the macrocyclization reagent is a Ru reagent; and further wherein said contacting step results in a covalent linkage being formed between the alkyne and azide moiety in the precursor. For example, $R^{12}$ may be methyl when the macrocyclization reagent is a Ru reagent.

In some embodiments, provided herein is a method for synthesizing a peptidomimetic macrocycle of Formula II, the method comprising the steps of contacting a peptidomimetic precursor of formula:

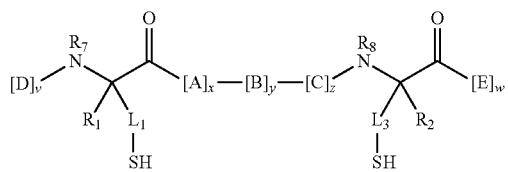

with a compound formula X-$L_2$-Y, wherein v, w, x, y, z, A, B, C, D, E, $R_1$, $R_2$, $R_7$, $R_8$, $L_1$ and $L_2$ are as defined for the compound of formula II; and X and Y are each independently a reactive group capable of reacting with a thiol group;

and further wherein said contacting step results in a covalent linkage being formed between the two thiol groups in Formula III.

In the peptidomimetic macrocycles disclosed herein, at least one of $R_1$ and $R_2$ is alkyl, alkenyl, alkynyl, arylalkyl, cycloalkyl, cycloalkylalkyl, heteroalkyl, or heterocycloalkyl, unsubstituted or substituted with halo-. In some embodiments, both $R_1$ and $R_2$ are independently alkyl, alkenyl, alkynyl, arylalkyl, cycloalkyl, cycloalkylalkyl, heteroalkyl, or heterocycloalkyl, unsubstituted or substituted with halo-. In some embodiments, at least one of A, B, C, D or E is an α,α-disubstituted amino acid. In one example, B is an α,α-disubstituted amino acid. For instance, at least one of A, B, C, D or E is 2-aminoisobutyric acid.

For example, at least one of $R_1$ and $R_2$ is alkyl, unsubstituted or substituted with halo-. In another example, both $R_1$ and $R_2$ are independently alkyl, unsubstituted or substituted with halo-. In some embodiments, at least one of $R_1$ and $R_2$ is methyl. In other embodiments, $R_1$ and $R_2$ are methyl. The macrocyclization reagent may be a Cu reagent or a Ru reagent.

In some embodiments, the peptidomimetic precursor is purified prior to the contacting step. In other embodiments, the peptidomimetic macrocycle is purified after the contacting step. In still other embodiments, the peptidomimetic macrocycle is refolded after the contacting step. The method may be performed in solution, or, alternatively, the method may be performed on a solid support.

Also envisioned herein is performing the method disclosed herein in the presence of a target macromolecule that binds to the peptidomimetic precursor or peptidomimetic macrocycle under conditions that favor said binding. In some embodiments, the method is performed in the presence of a target macromolecule that binds preferentially to the peptidomimetic precursor or peptidomimetic macrocycle under conditions that favor said binding. The method may also be applied to synthesize a library of peptidomimetic macrocycles.

In some embodiments, an alkyne moiety of the peptidomimetic precursor for making a compound of Formula I is a sidechain of an amino acid selected from the group consisting of L-propargylglycine, D-propargylglycine, (S)-2-amino-2-methyl-4-pentynoic acid, (R)-2-amino-2-methyl-4-pentynoic acid, (S)-2-amino-2-methyl-5-hexynoic acid, (R)-2-amino-2-methyl-5-hexynoic acid, (S)-2-amino-2-methyl-6-heptynoic acid, (R)-2-amino-2-methyl-6-heptynoic acid, (S)-2-amino-2-methyl-7-octynoic acid, (R)-2-amino-2-methyl-7-octynoic acid, (S)-2-amino-2-methyl-8-nonynoic acid, and (R)-2-amino-2-methyl-8-nonynoic acid. In other embodiments, an azide moiety of the peptidomimetic precursor for making a compound of Formula I is a sidechain of an amino acid selected from the group consisting of ε-azido-L-lysine, ε-azido-D-lysine, ε-azido-α-methyl-L-lysine, ε-azido-α-methyl-D-lysine, δ-azido-α-methyl-L-ornithine, and δ-azido-α-methyl-D-ornithine.

In some embodiments, a thiol group of the peptidomimetic precursor for making a compound of Formula II is a sidechain of an amino acid selected from the group consisting of L-cysteine, D-cysteine, L-N-methylcysteine, D-N-methylcysteine, L-homocysteine, D-homocysteine, L-N-methylhomocysteine, D-N-methylhomocysteine, α-methyl-L-cysteine, α-methyl-D-cysteine, α-methyl-L-homocysteine, α-methyl-D-homocysteine, L-penicillamine, D-penicillamine, L-N-methylpenicillamine, D-N-methylpenicillamine and all forms suitably protected for liquid or solid phase peptide synthesis.

In some embodiments, x+y+z is 3, and A, B and C are independently natural or non-natural amino acids. In other embodiments, x+y+z is 6, and A, B and C are independently natural or non-natural amino acids.

In some embodiments, the contacting step is performed in a solvent selected from the group consisting of protic solvent, aqueous solvent, organic solvent, and mixtures thereof. For example, the solvent may be chosen from the group consisting of $H_2O$, THF, THF/$H_2O$, tBuOH/$H_2O$, DMF, DIPEA, $CH_3CN$ or $CH_2Cl_2$, $ClCH_2CH_2Cl$ or a mixture thereof. The solvent may be a solvent which favors helix formation.

Alternative but equivalent protecting groups, leaving groups or reagents are substituted, and certain of the synthetic steps are performed in alternative sequences or orders to produce the desired compounds. Synthetic chemistry transformations and protecting group methodologies (protection and deprotection) useful in synthesizing the compounds described herein include, for example, those such as described in Larock, *Comprehensive Organic Transformations*, VCH Publishers (1989); Greene and Wuts, *Protective Groups in Organic Synthesis*, 2d. Ed., John Wiley and Sons (1991); Fieser and Fieser, *Fieser and Fieser's Reagents for Organic Synthesis*, John Wiley and Sons (1994); and Paquette, ed., *Encyclopedia of Reagents for Organic Synthesis*, John Wiley and Sons (1995), and subsequent editions thereof.

The peptidomimetic macrocycles disclosed herein are made, for example, by chemical synthesis methods, such as described in Fields et al., Chapter 3 in *Synthetic Peptides: A User's Guide*, ed. Grant, W. H. Freeman & Co., New York, N.Y., 1992, p. 77. Hence, for example, peptides are synthesized using the automated Merrifield techniques of solid phase synthesis with the amine protected by either tBoc or Fmoc chemistry using side chain protected amino acids on, for example, an automated peptide synthesizer (e.g., Applied Biosystems (Foster City, Calif.), Model 430A, 431, or 433).

One manner of producing the peptidomimetic precursors and peptidomimetic macrocycles described herein uses solid phase peptide synthesis (SPPS). The C-terminal amino acid is attached to a cross-linked polystyrene resin via an acid labile bond with a linker molecule. This resin is insoluble in the solvents used for synthesis, making it relatively simple and fast to wash away excess reagents and by-products. The N-terminus is protected with the Fmoc group, which is stable in acid, but removable by base. Side chain functional groups are protected as necessary with base stable, acid labile groups.

Longer peptidomimetic precursors are produced, for example, by conjoining individual synthetic peptides using native chemical ligation. Alternatively, the longer synthetic peptides are biosynthesized by well known recombinant DNA and protein expression techniques. Such techniques are provided in well-known standard manuals with detailed protocols. To construct a gene encoding a peptidomimetic precursor disclosed herein, the amino acid sequence is reverse translated to obtain a nucleic acid sequence encoding the amino acid sequence, preferably with codons that are optimum for the organism in which the gene is to be expressed. Next, a synthetic gene is made, typically by synthesizing oligonucleotides which encode the peptide and any regulatory elements, if necessary. The synthetic gene is inserted in a suitable cloning vector and transfected into a host cell. The peptide is then expressed under suitable conditions appropriate for the selected expression system and host. The peptide is purified and characterized by standard methods.

The peptidomimetic precursors are made, for example, in a high-throughput, combinatorial fashion using, for example, a high-throughput polychannel combinatorial synthesizer (e.g., Thuramed TETRAS multichannel peptide synthesizer from CreoSalus, Louisville, Ky. or Model Apex 396 multichannel peptide synthesizer from AAPPTEC, Inc., Louisville, Ky.).

The following synthetic schemes are provided solely to illustrate the present invention and are not intended to limit the scope of the invention, as described herein.

Synthetic schemes 1-5 describe the preparation of peptidomimetic macrocycles of Formula I. To simplify the drawings, the illustrative schemes depict azido amino acid analogs ε-azido-α-methyl-L-lysine and ε-azido-α-methyl-D-lysine, and alkyne amino acid analogs L-propargylglycine, (S)-2-amino-2-methyl-4-pentynoic acid, and (S)-2-amino-2-methyl-6-heptynoic acid. Thus, in the following synthetic schemes, each $R_1$, $R_2$, $R_7$ and $R_8$ is —H; each $L_1$ is —$(CH_2)_4$—; and each $L_2$ is —$(CH_2)$—. However, as noted throughout the detailed description above, many other amino acid analogs can be employed in which $R_1$, $R_2$, $R_7$, $R_8$, $L_1$ and $L_2$ can be independently selected from the various structures disclosed herein.

Synthetic Scheme 1:

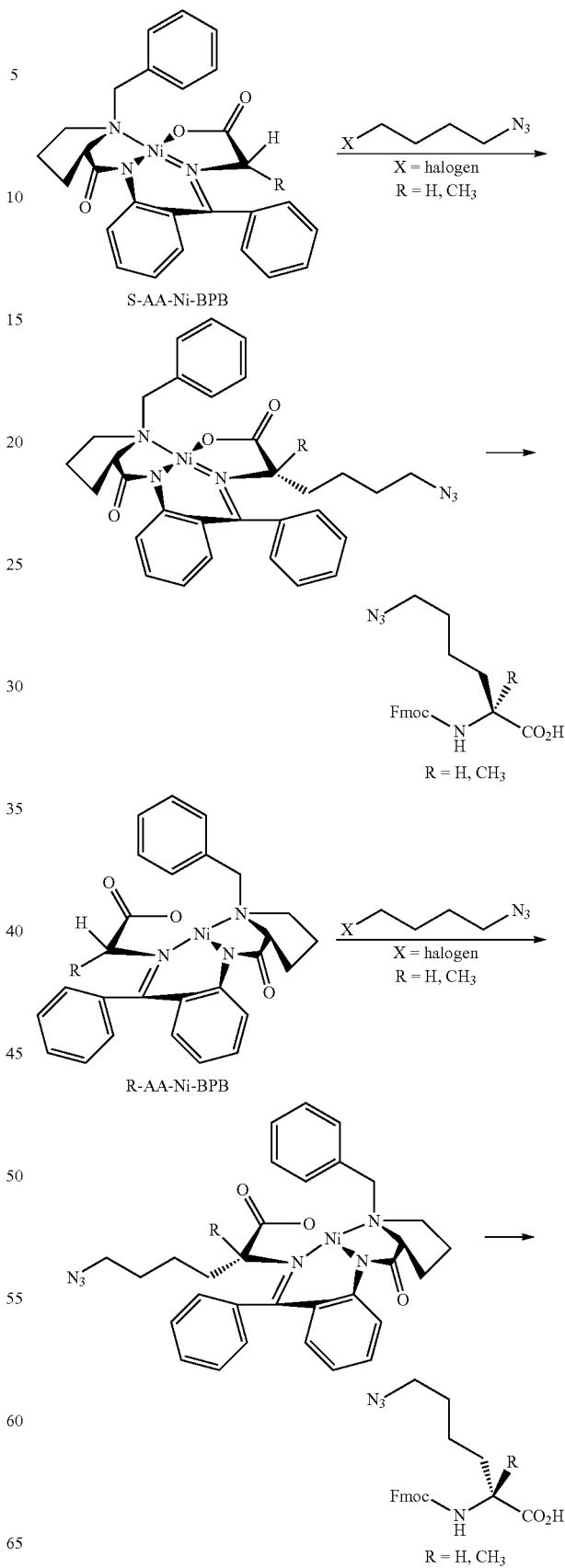

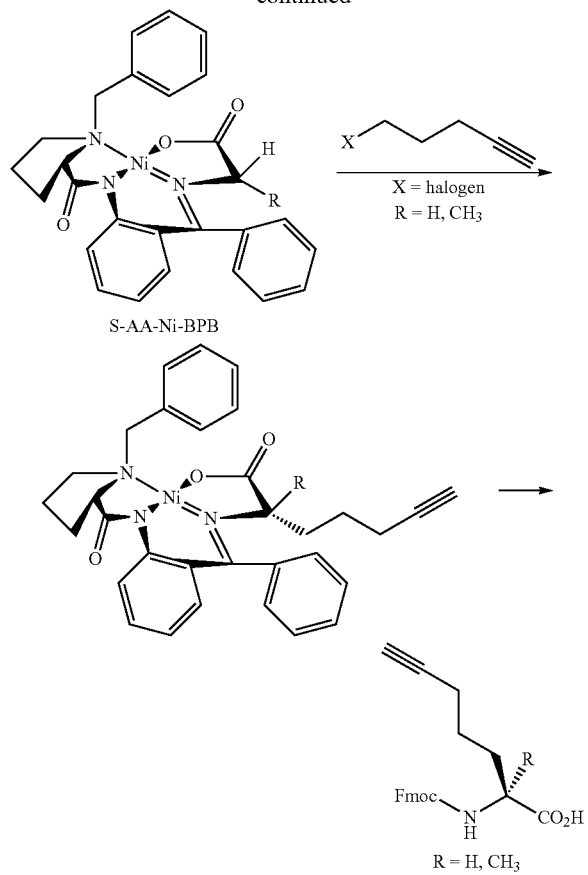

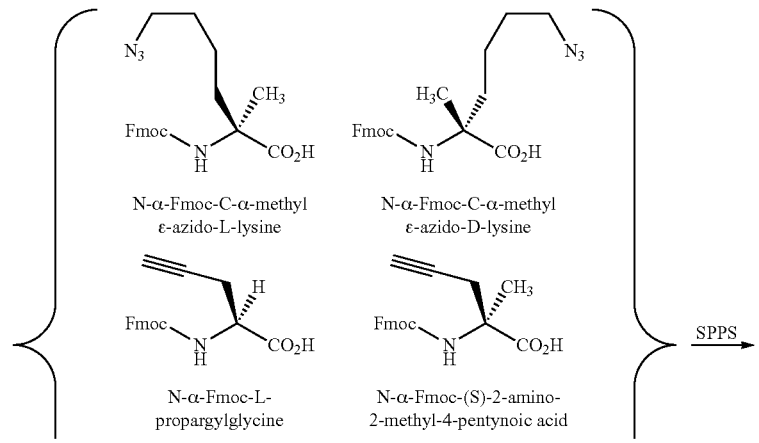

Synthetic Scheme 1 describes the preparation of several compounds useful for preparing compounds of Formula I as disclosed herein. Ni(II) complexes of Schiff bases derived from the chiral auxiliary (S)-2-[N—(N'-benzylprolyl)amino] benzophenone (BPB) and amino acids such as glycine or alanine are prepared as described in Belokon et al. (1998), *Tetrahedron Asymm.* 9:4249-4252. The resulting complexes are subsequently reacted with alkylating reagents comprising an azido or alkynyl moiety to yield enantiomerically enriched compounds disclosed herein. If desired, the resulting compounds can be protected for use in peptide synthesis.

Synthetic Scheme 2:

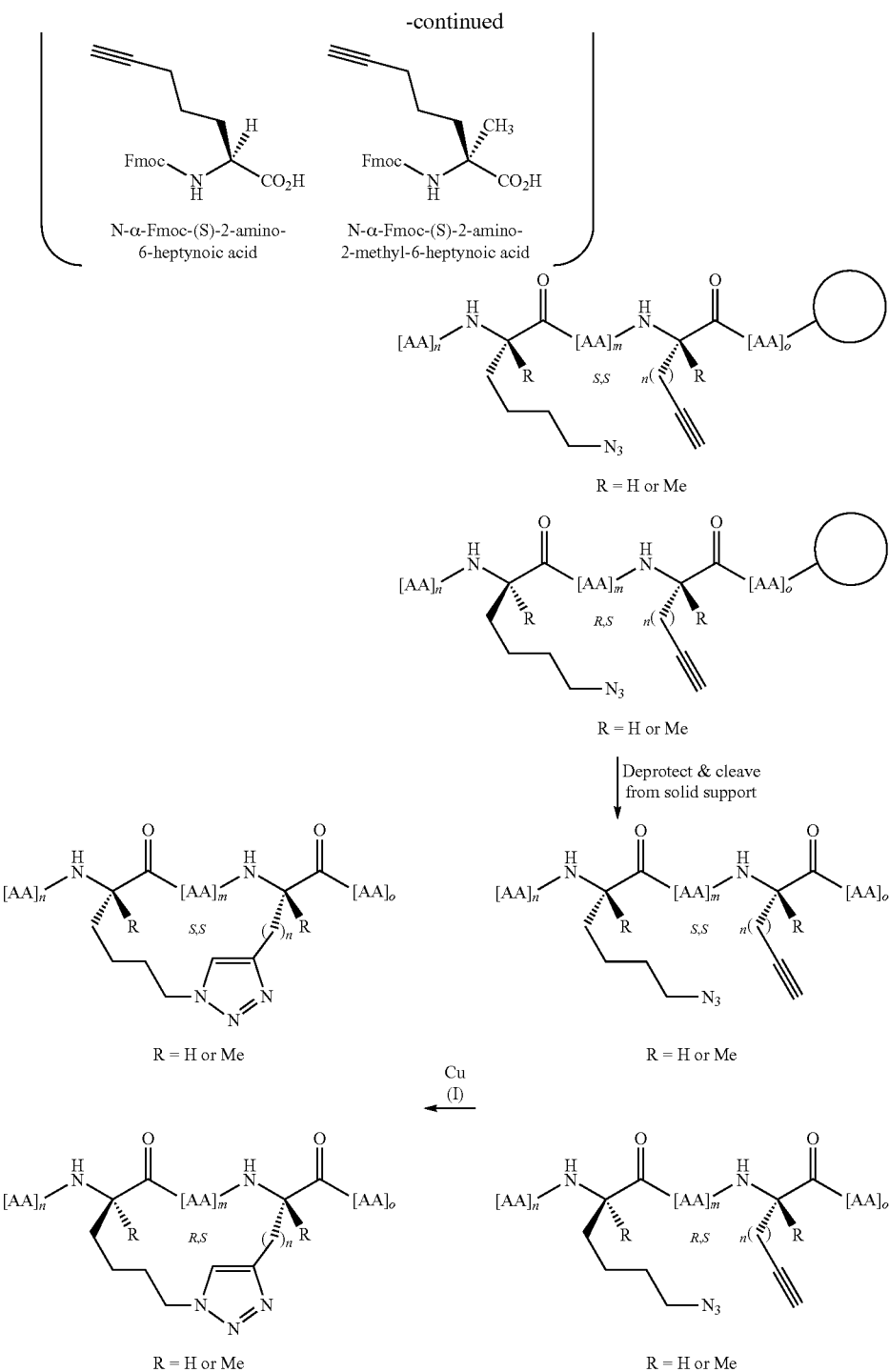

In the general method for the synthesis of peptidomimetic macrocycles of Formula I shown in Synthetic Scheme 2, the peptidomimetic precursor contains an azide moiety and an alkyne moiety and is synthesized by solution-phase or solid-phase peptide synthesis (SPPS) using the commercially available amino acid N-α-Fmoc-L-propargylglycine and the N-α-Fmoc-protected forms of the amino acids (S)-2-amino-2-methyl-4-pentynoic acid, (S)-2-amino-6-heptynoic acid, (S)-2-amino-2-methyl-6-heptynoic acid, N-methyl-ε-azido-L-lysine, and N-methyl-ε-azido-D-lysine. The peptidomimetic precursor is then deprotected and cleaved from the solid-phase resin by standard conditions (e.g., strong acid such as 95% TFA). The peptidomimetic precursor is reacted as a crude mixture or is purified prior to reaction with a macrocyclization reagent such as a Cu(I) in organic or aqueous solutions (Rostovtsev et al. (2002), *Angew. Chem. Int. Ed.* 41:2596-2599; Tornoe et al. (2002), *J. Org. Chem.* 67:3057-3064; Deiters et al. (2003), *J. Am. Chem. Soc.* 125:11782-11783; Punna et al. (2005), *Angew. Chem. Int. Ed.* 44:2215-2220). In one embodiment, the triazole forming reaction is performed under conditions that favor α-helix formation. In one embodiment, the macrocyclization step is performed in a solvent chosen from the group consisting of H₂O, THF, CH₃CN, DMF, DIPEA, tBuOH or a mixture thereof. In another embodiment, the macrocyclization step is performed in DMF. In some embodiments, the macrocyclization step is performed in a buffered aqueous or partially aqueous solvent.

Synthetic Scheme 3:

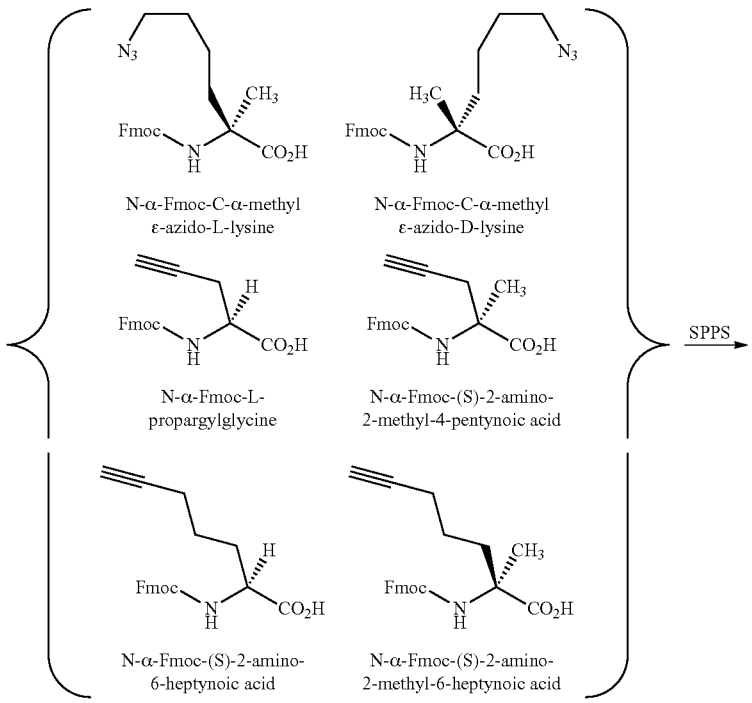

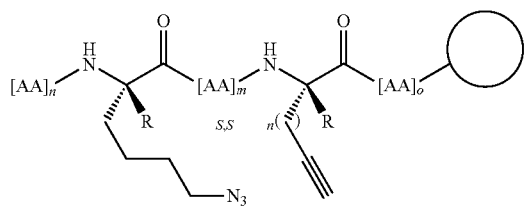

R = H or Me

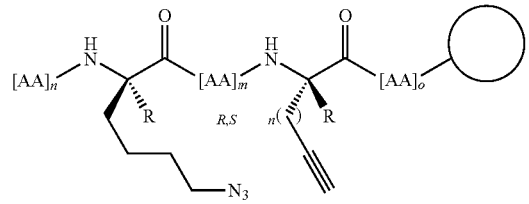

R = H or Me

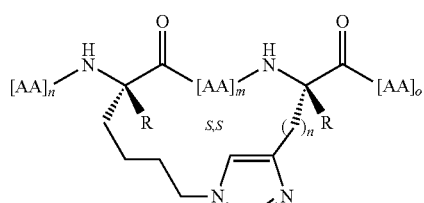

R = H or Me

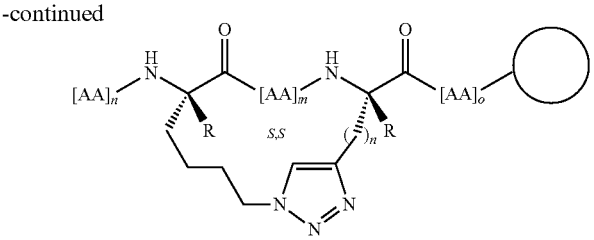

R = H or Me

Deprotect & cleave from solid support ←

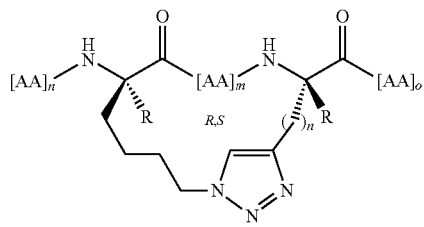

R = H or Me

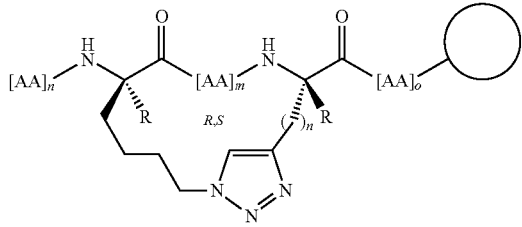

R = H or Me

In the general method for the synthesis of peptidomimetic macrocycles of Formula I shown in Synthetic Scheme 3, the peptidomimetic precursor contains an azide moiety and an alkyne moiety and is synthesized by solid-phase peptide synthesis (SPPS) using the commercially available amino acid N-α-Fmoc-L-propargylglycine and the N-α-Fmoc-protected forms of the amino acids (S)-2-amino-2-methyl-4-pentynoic acid, (S)-2-amino-6-heptynoic acid, (S)-2-amino-2-methyl-6-heptynoic acid, N-methyl-ε-azido-L-lysine, and N-methyl-ε-azido-D-lysine. The peptidomimetic precursor is reacted with a macrocyclization reagent such as a Cu(I) reagent on the resin as a crude mixture (Rostovtsev et al. (2002), *Angew. Chem. Int. Ed.* 41:2596-2599; Tornoe et al. (2002), *J. Org. Chem.* 67:3057-3064; Deiters et al. (2003), *J. Am. Chem. Soc.* 125:11782-11783; Punna et al. (2005), *Angew. Chem. Int. Ed.* 44:2215-2220). The resultant triazole-containing peptidomimetic macrocycle is then deprotected and cleaved from the solid-phase resin by standard conditions (e.g., strong acid such as 95% TFA). In some embodiments, the macrocyclization step is performed in a solvent chosen from the group consisting of $CH_2Cl_2$, $ClCH_2CH_2Cl$, DMF, THF, NMP, DIPEA, 2,6-lutidine, pyridine, DMSO, $H_2O$ or a mixture thereof. In some embodiments, the macrocyclization step is performed in a buffered aqueous or partially aqueous solvent.

Synthetic Scheme 4:

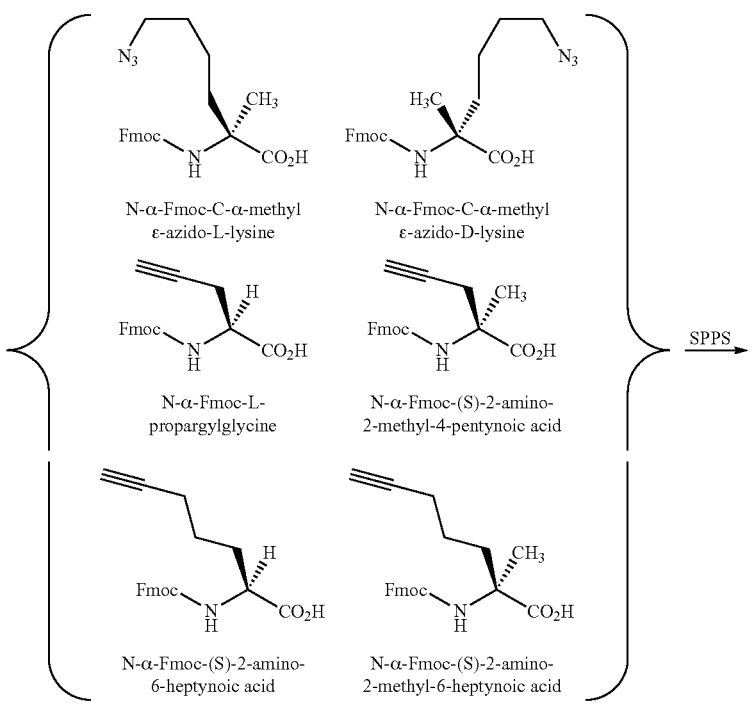

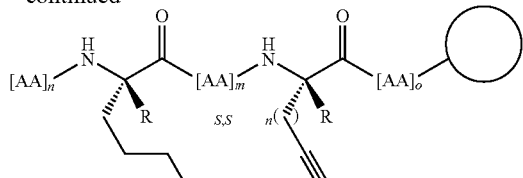

R = H or Me

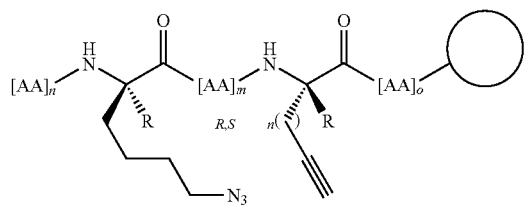

R = H or Me

Deprotect & cleave from solid support ↓

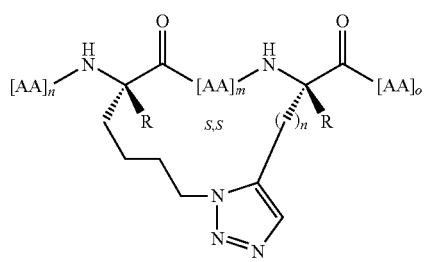

R = H or Me

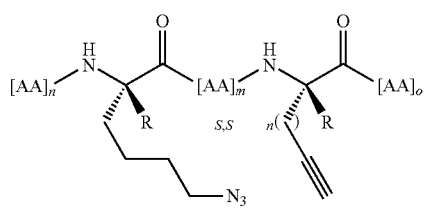

R = H or Me

← Ru(II)

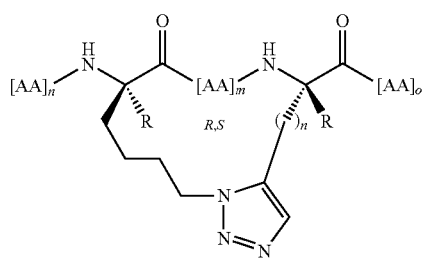

R = H or Me

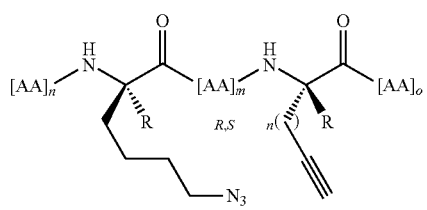

R = H or Me

In the general method for the synthesis of peptidomimetic macrocycles of Formula I shown in Synthetic Scheme 4, the peptidomimetic precursor contains an azide moiety and an alkyne moiety and is synthesized by solution-phase or solid-phase peptide synthesis (SPPS) using the commercially available amino acid N-α-Fmoc-L-propargylglycine and the N-α-Fmoc-protected forms of the amino acids (S)-2-amino-2-methyl-4-pentynoic acid, (S)-2-amino-6-heptynoic acid, (S)-2-amino-2-methyl-6-heptynoic acid, N-methyl-ε-azido-L-lysine, and N-methyl-ε-azido-D-lysine. The peptidomimetic precursor is then deprotected and cleaved from the solid-phase resin by standard conditions (e.g., strong acid such as 95% TFA). The peptidomimetic precursor is reacted as a crude mixture or is purified prior to reaction with a macrocyclization reagent such as a Ru(II) reagents, for example Cp*RuCl(PPh$_3$)$_2$ or [Cp*RuCl]$_4$ (Rasmussen et al. (2007), *Org. Lett.* 9:5337-5339; Zhang et al. (2005), *J. Am. Chem. Soc.* 127:15998-15999). In some embodiments, the macrocyclization step is performed in a solvent chosen from the group consisting of DMF, CH$_3$CN and THF.

Synthetic Scheme 5:
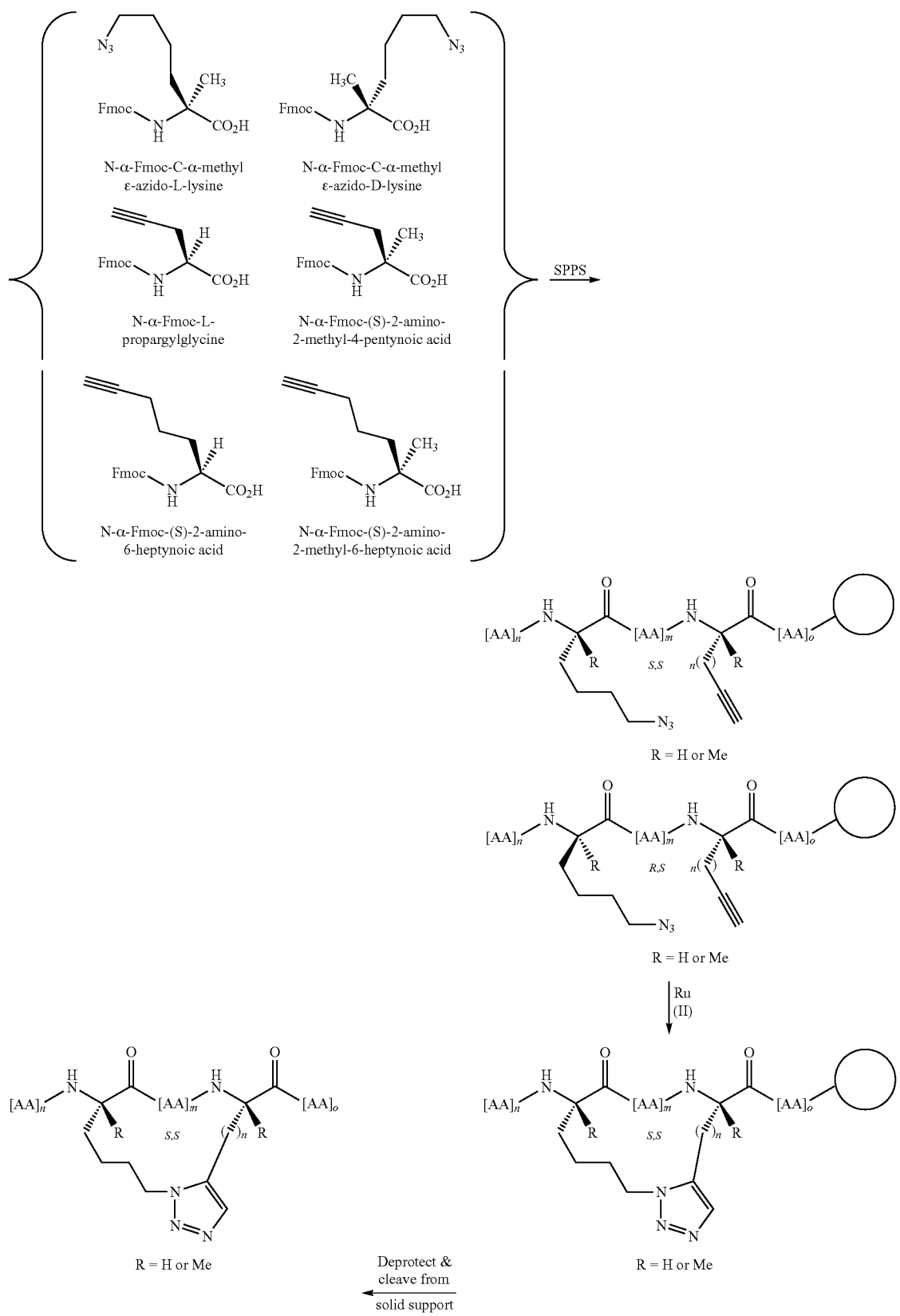

75

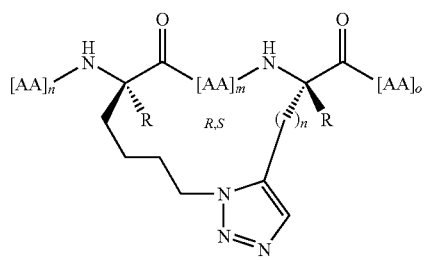

R = H or Me

76

-continued

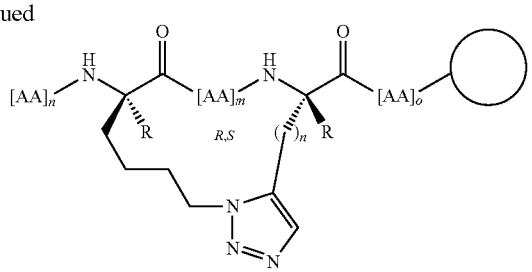

R = H or Me

In the general method for the synthesis of peptidomimetic macrocycles of Formula I shown in Synthetic Scheme 5, the peptidomimetic precursor contains an azide moiety and an alkyne moiety and is synthesized by solid-phase peptide synthesis (SPPS) using the commercially available amino acid N-α-Fmoc-L-propargylglycine and the N-α-Fmoc-protected forms of the amino acids (S)-2-amino-2-methyl-4-pentynoic acid, (S)-2-amino-6-heptynoic acid, (S)-2-amino-2-methyl-6-heptynoic acid, N-methyl-ε-azido-L-lysine, and N-methyl-ε-azido-D-lysine. The peptidomimetic precursor is reacted with a macrocyclization reagent such as a Ru(II) reagent on the resin as a crude mixture. For example, the reagent can be Cp*RuCl(PPh$_3$)$_2$ or [Cp*RuCl]$_4$ (Rasmussen et al. (2007), Org. Lett. 9:5337-5339; Zhang et al. (2005), J. Am. Chem. Soc. 127:15998-15999). In some embodiments, the macrocyclization step is performed in a solvent chosen from the group consisting of CH$_2$Cl$_2$, ClCH$_2$CH$_2$Cl, CH$_3$CN, DMF, and THF.

In some embodiments, a peptidomimetic macrocycle of Formula I comprises a halogen group substitution on a triazole moiety, for example an iodo substitution. Such peptidomimetic macrocycles may be prepared from a precursor having the partial structure and using the cross-linking methods taught herein. Crosslinkers of any length, as described herein, may be prepared comprising such substitutions. In one embodiment, the peptidomimetic macrocycle is prepared according to the scheme shown below. The reaction is performed, for example, in the presence of CuI and an amine ligand such as TEA or TTTA. See, e.g., Hein et al. Angew. Chem., Int. Ed. 2009, 48, 8018-8021.

-continued

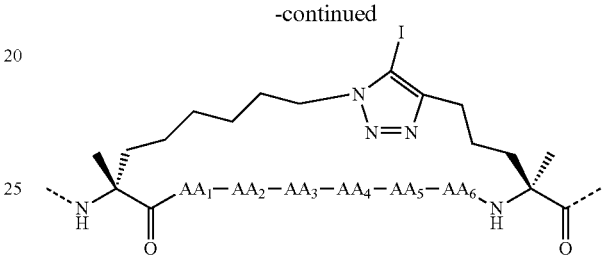

In other embodiments, an iodo-substituted triazole is generated according to the scheme shown below. For example, the second step in the reaction scheme below is performed using, for example, CuI and N-bromosuccinimide (NBS) in the presence of THF (see, e.g. Zhang et al., J. Org. Chem. 2008, 73, 3630-3633). In other embodiments, the second step in the reaction scheme shown below is performed, for example, using CuI and an iodinating agent such as ICl (see, e.g. Wu et al., Synthesis 2005, 1314-1318.)

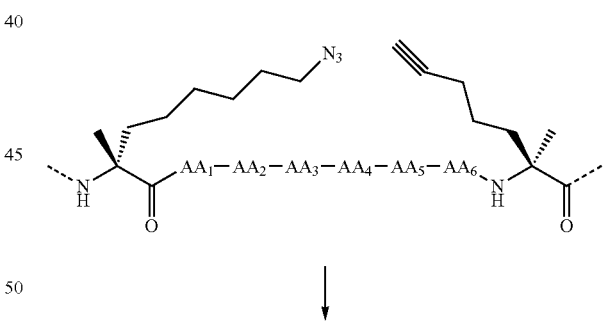

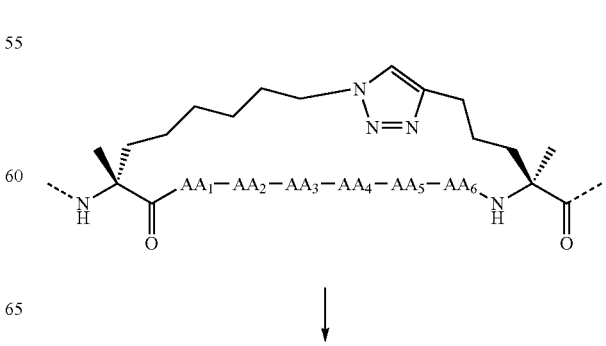

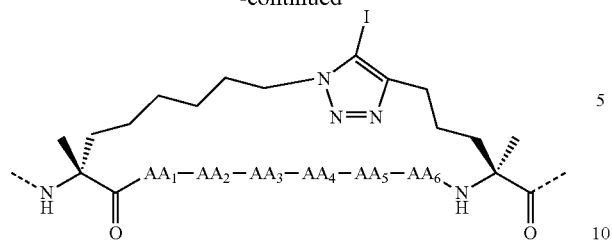

In some embodiments, an iodo-substituted triazole moiety is used in a cross-coupling reaction, such as a Suzuki or Sonogashira coupling, to afford a peptidomimetic macrocycle comprising a substituted crosslinker. Sonogashira couplings using an alkyne as shown below may be performed, for example, in the presence of a palladium catalyst such as Pd(PPh$_3$)$_2$Cl$_2$, CuI, and in the presence of a base such as triethylamine. Suzuki couplings using an arylboronic or substituted alkenyl boronic acid as shown below may be performed, for example, in the presence of a catalyst such as Pd(PPh$_3$)$_4$, and in the presence of a base such as K$_2$CO$_3$.

Any suitable triazole substituent groups which reacts with the iodo-substituted triazole can be used in Suzuki couplings described herein. Example triazole substituents for use in Suzuki couplings are shown below:

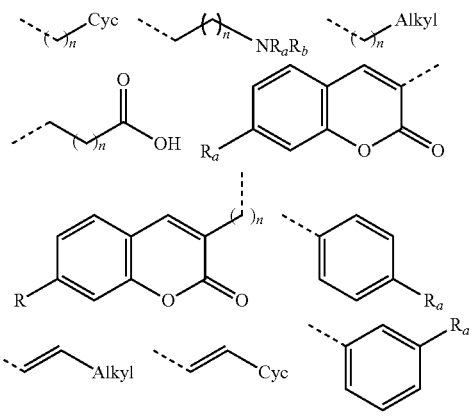

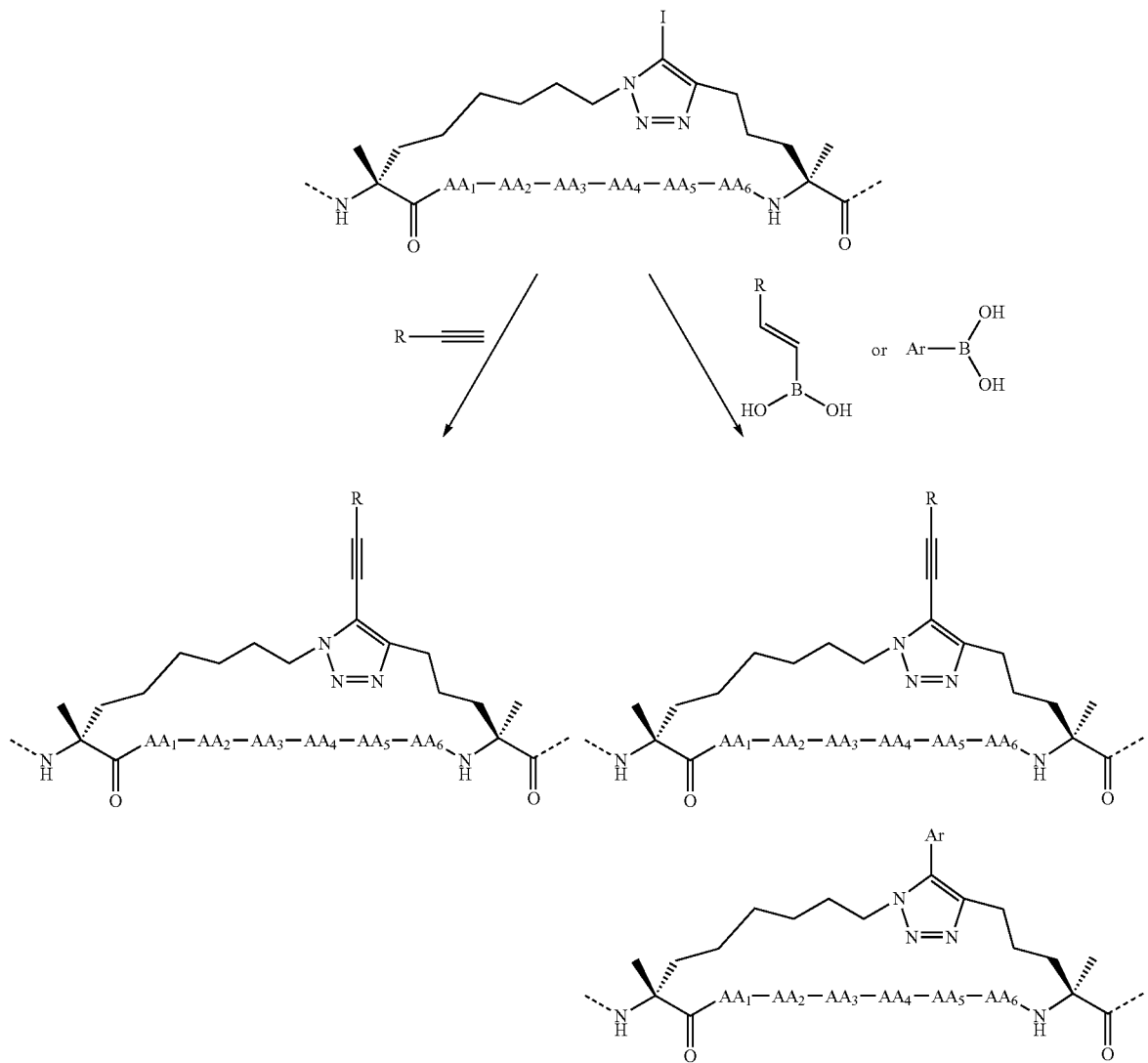

-continued

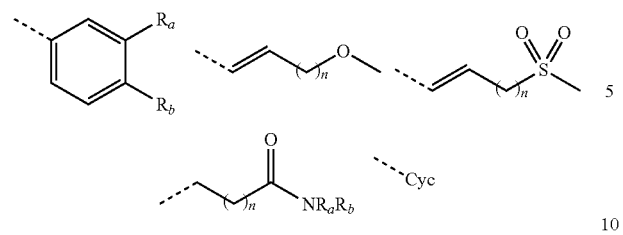

wherein "Cyc" is a suitable aryl, cycloalkyl, cycloalkenyl, heteroaryl, or heterocyclyl group, unsubstituted or optionally substituted with an $R_a$ or $R_b$ group as described below.

In some embodiments, the substituent is:

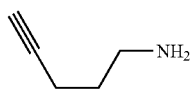

Any suitable substituent group which reacts with the iodo-substituted triazole can be used in Sonogashira couplings described herein. Example triazole substituents for use in Sonogashira couplings are shown below:

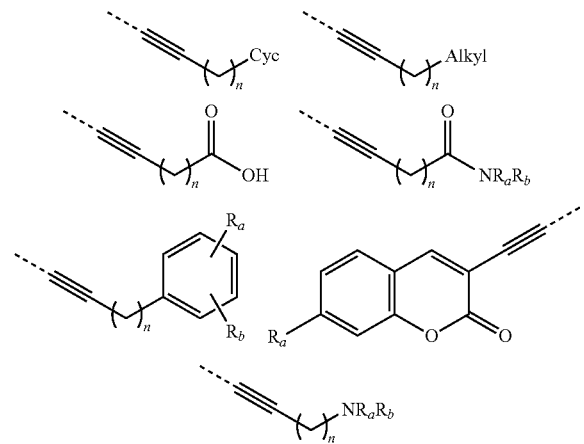

wherein "Cyc" is a suitable aryl, cycloalkyl, cycloalkenyl, heteroaryl, or heterocyclyl group, unsubstituted or optionally substituted with an $R_a$ or $R_b$ group as described below.

In some embodiments, the triazole substituent is:

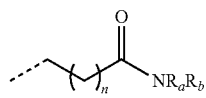

In some embodiments, the Cyc group shown above is further substituted by at least one $R_a$ or $R_b$ substituent. In some embodiments, at least one of $R_a$ and $R_b$ is independently:

$R_a$ or $R_b$ = H, OCH$_3$, CF$_3$, NH$_2$, CH$_2$NH$_2$, F, Br, I

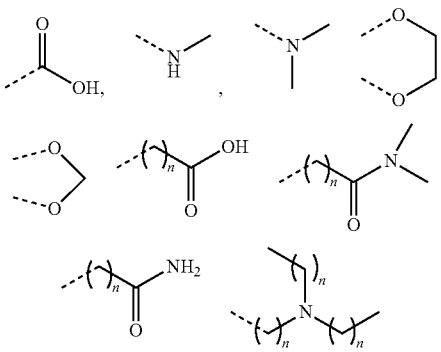

In other embodiments, the triazole substituent is

and at least one of $R_a$ and $R_b$ is alkyl (including hydrogen, methyl, or ethyl), or:

The present invention contemplates the use of non-naturally-occurring amino acids and amino acid analogs in the synthesis of the peptidomimetic macrocycles of Formula I described herein. Any amino acid or amino acid analog amenable to the synthetic methods employed for the synthesis of stable triazole containing peptidomimetic macrocycles can be used in the present invention. For example, L-propargylglycine is contemplated as a useful amino acid in the present invention. However, other alkyne-containing amino acids that contain a different amino acid side chain are also useful in the invention. For example, L-propargylglycine contains one methylene unit between the α-carbon of the amino acid and the alkyne of the amino acid side chain. The invention also contemplates the use of amino acids with multiple methylene units between the α-carbon and the alkyne. Also, the azido-analogs of amino acids L-lysine, D-lysine, alpha-methyl-L-lysine, and alpha-methyl-D-lysine are contemplated as useful amino acids in the present invention. However, other terminal azide amino acids that contain a different amino acid side chain are also useful in the invention. For example, the azido-analog of L-lysine contains four methylene units between the α-carbon of the amino acid and the terminal azide of the amino acid side chain. The invention also contemplates the use of amino acids with fewer than or greater than four methylene units between the α-carbon and the terminal azide. The following Table 1 shows some amino acids useful in the preparation of peptidomimetic macrocycles disclosed herein.

TABLE 1

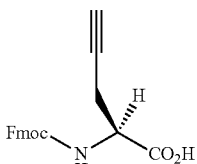

N-α-Fmoc-L-
propargyl glycine

N-α-Fmoc-D-
propargyl glycine

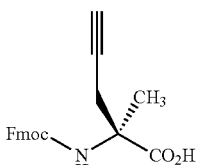

N-α-Fmoc-(S)-2-amino-2-
methyl-4-pentynoic acid

N-α-Fmoc-(R)-2-amino-2-
methyl-4-pentynoic acid

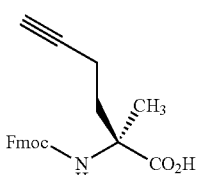

N-α-Fmoc-(S)-2-amino-2-
methyl-5-hexynoic acid

N-α-Fmoc-(R)-2-amino-2-
methyl-5-hexynoic acid

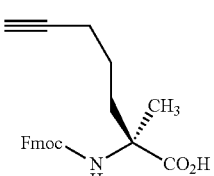

N-α-Fmoc-(S)-2-amino-2-
methyl-6-heptynoic acid

N-α-Fmoc-(R)-2-amino-2-
methyl-6-heptynoic acid

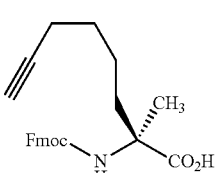

N-α-Fmoc-(S)-2-amino-2-
methyl-7-octynoic acid

N-α-Fmoc-(R)-2-amino-2-
methyl-7-octynoic acid

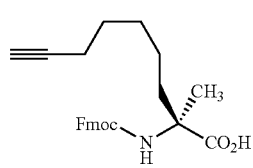

N-α-Fmoc-(S)-2-amino-2-
methyl-8-nonynoic acid

N-α-Fmoc-(R)-2-amino-2-
methyl-8-nonynoic acid

TABLE 1-continued

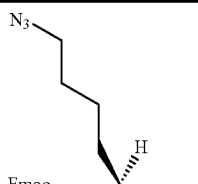

N-α-Fmoc-ε-azido-
L-lysine

N-α-Fmoc-ε-azido-
D-lysine

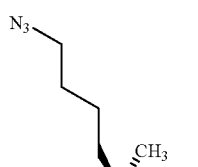

N-α-Fmoc-ε-azido-
α-methyl-L-lysine

N-α-Fmoc-ε-azido-
α-methyl-D-lysine

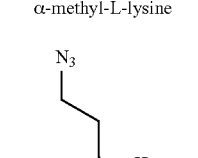

N-α-Fmoc-δ-azido-
L-ornithine

N-α-Fmoc-δ-azido-
D-ornithine

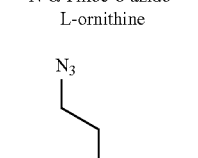

N-α-Fmoc-ε-azido-
α-methyl-L-
ornithine

N-α-Fmoc-ε-azido-
α-methyl-D-
ornithine

Table 1 shows exemplary amino acids useful in the preparation of peptidomimetic macrocycles disclosed herein.

In some embodiments the amino acids and amino acid analogs are of the D-configuration. In other embodiments they are of the L-configuration. In some embodiments, some of the amino acids and amino acid analogs contained in the peptidomimetic are of the D-configuration while some of the amino acids and amino acid analogs are of the L-configuration. In some embodiments the amino acid analogs are α,α-disubstituted, such as α-methyl-L-propargylglycine, α-methyl-D-propargylglycine, ε-azido-alpha-methyl-L-lysine, and ε-azido-alpha-methyl-D-lysine. In some embodiments the amino acid analogs are N-alkylated, e.g., N-methyl-L-propargylglycine, N-methyl-D-propargylglycine, N-methyl-ε-azido-L-lysine, and N-methyl-ε-azido-D-lysine.

The preparation of macrocycles of Formula II is described, for example, in U.S. application Ser. No. 11/957,325, filed on Dec. 17, 2007 and herein incorporated by reference. Synthetic Schemes 6-9 describe the preparation of such compounds of Formula II. To simplify the drawings, the illustrative schemes depict amino acid analogs derived from L- or D-cysteine, in which $L_1$ and $L_3$ are both —$(CH_2)$—. However, as noted throughout the detailed description above, many other amino acid analogs can be employed in which $L_1$ and $L_3$ can be independently selected from the various structures disclosed herein. The symbols "$[AA]_m$", "$[AA]_n$", "$[AA]_o$," represent a sequence of amide bond-linked moieties such as natural or unnatural amino acids. As described previously, each occurrence of "AA" is independent of any other occurrence of "AA", and a formula such as "$[AA]_m$" encompasses, for example, sequences of non-identical amino acids as well as sequences of identical amino acids.

Synthetic Scheme 6:

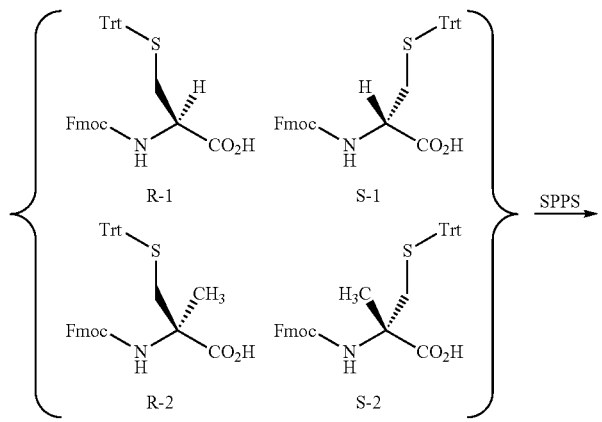

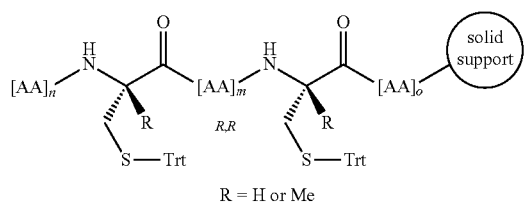

R = H or Me

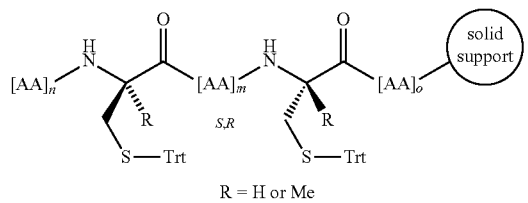

R = H or Me

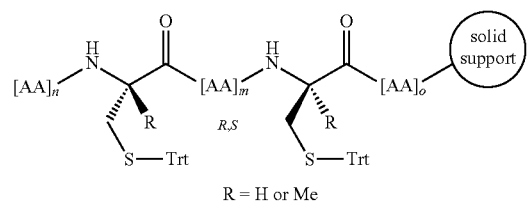

R = H or Me

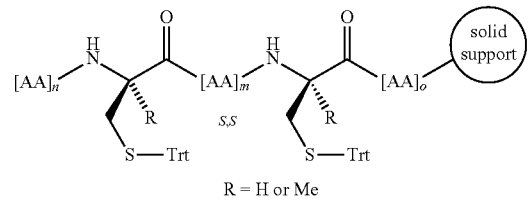

R = H or Me

Deprotect & cleave from solid support

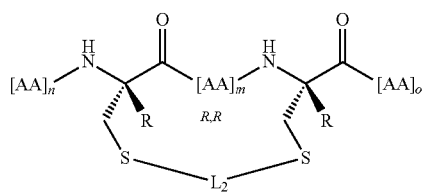

R = H or Me

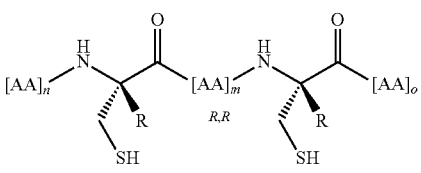

R = H or Me

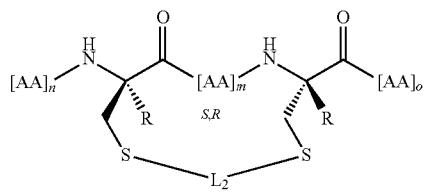

R = H or Me

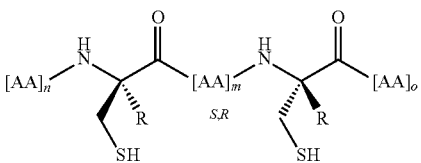

R = H or Me $\xleftarrow{X-L_2-Y}$

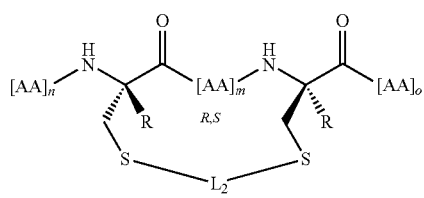

R = H or Me

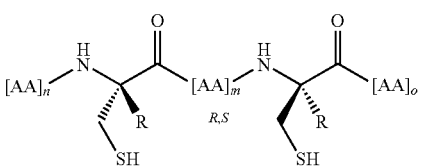

R = H or Me

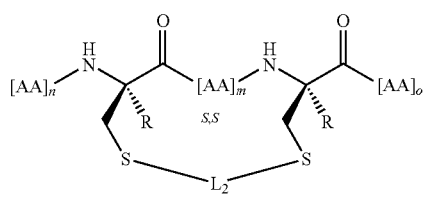

R = H or Me

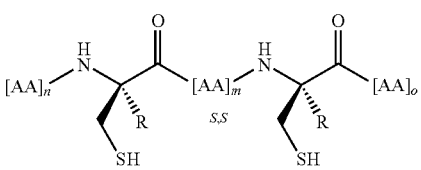

R = H or Me

In Scheme 6, the peptidomimetic precursor contains two —SH moieties and is synthesized by solid-phase peptide synthesis (SPPS) using commercially available N-α-Fmoc amino acids such as N-α-Fmoc-S-trityl-L-cysteine or N-α-Fmoc-S-trityl-D-cysteine. Alpha-methylated versions of D-cysteine or L-cysteine are generated by known methods (Seebach et al. (1996), *Angew. Chem. Int. Ed. Engl.* 35:2708-2748, and references therein) and then converted to the appropriately protected N-α-Fmoc-S-trityl monomers by known methods ("*Bioorganic Chemistry: Peptides and Proteins*", Oxford University Press, New York: 1998, the entire contents of which are incorporated herein by reference). The precursor peptidomimetic is then deprotected and cleaved from the solid-phase resin by standard conditions (e.g., strong acid such as 95% TFA). The precursor peptidomimetic is reacted as a crude mixture or is purified prior to reaction with X-L$_2$-Y in organic or aqueous solutions. In some embodiments the alkylation reaction is performed under dilute conditions (i.e. 0.15 mmol/L) to favor macrocyclization and to avoid polymerization. In some embodiments, the alkylation reaction is performed in organic solutions such as liquid NH$_3$ (Mosberg et al. (1985), J. Am. Chem. Soc. 107:2986-2987; Szewczuk et al. (1992), Int. J. Peptide Protein Res. 40: 233-242), NH$_3$/MeOH, or NH$_3$/DMF (Or et al. (1991), J. Org. Chem. 56:3146-3149). In other embodiments, the alkylation is performed in an aqueous solution such as 6M guanidinium HCL, pH 8 (Brunel et al. (2005), Chem. Commun (20):2552-2554). In other embodiments, the solvent used for the alkylation reaction is DMF or dichloroethane.

Synthetic Scheme 7:
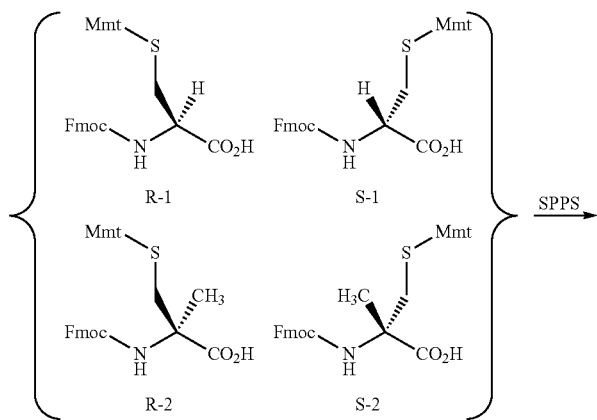
SPPS
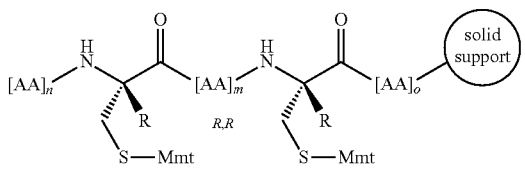
R = H or Me
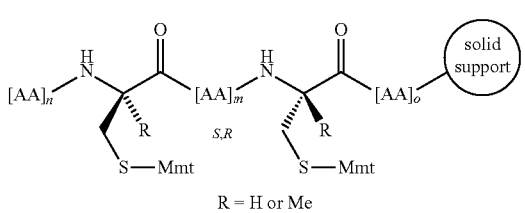
R = H or Me
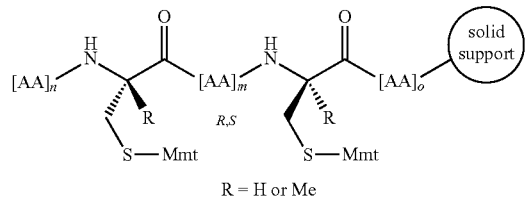
R = H or Me
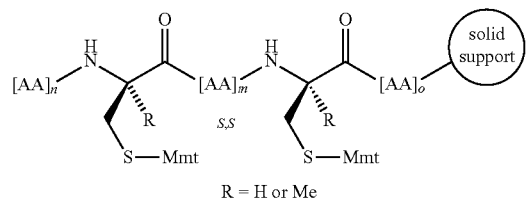
R = H or Me
Deprotect
R—S-Mmt

89

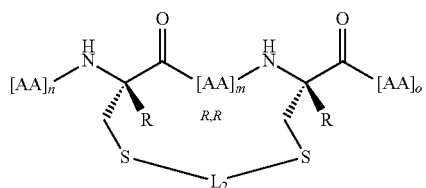

R = H or Me

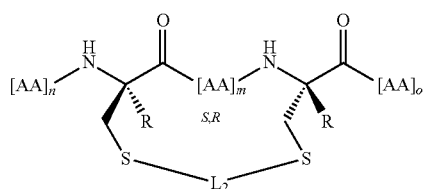

R = H or Me

90

-continued

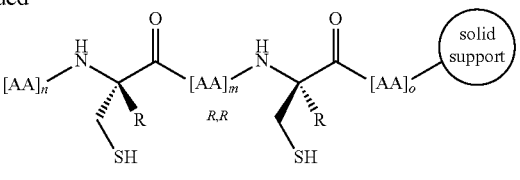

R = H or Me

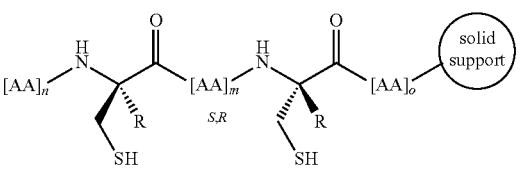

R = H or Me

X—L₂—Y
2. Deprotect
other AA's
& cleavage

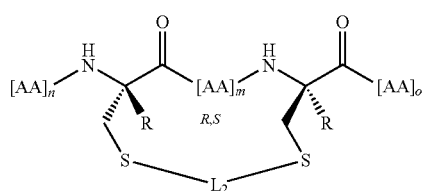

R = H or Me

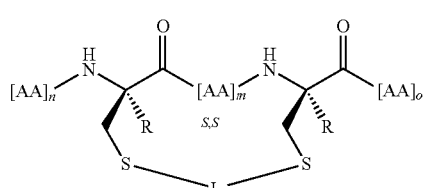

R = H or Me

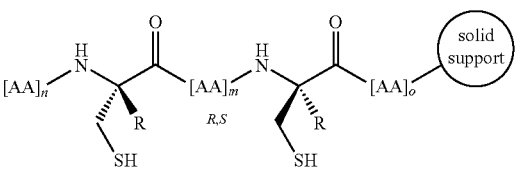

R = H or Me

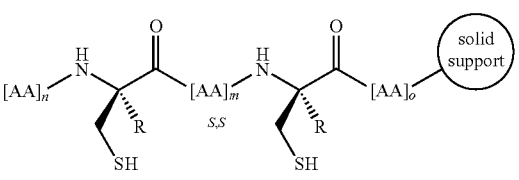

R = H or Me

In Scheme 7, the precursor peptidomimetic contains two or more —SH moieties, of which two are specially protected to allow their selective deprotection and subsequent alkylation for macrocycle formation. The precursor peptidomimetic is synthesized by solid-phase peptide synthesis (SPPS) using commercially available N-α-Fmoc amino acids such as N-α-Fmoc-S-p-methoxytrityl-L-cysteine or N-α-Fmoc-S-p-methoxytrityl-D-cysteine. Alpha-methylated versions of D-cysteine or L-cysteine are generated by known methods (Seebach et al. (1996), *Angew. Chem. Int. Ed. Engl.* 35:2708-2748, and references therein) and then converted to the appropriately protected N-α-Fmoc-S-p-methoxytrityl monomers by known methods (*Bioorganic Chemistry: Peptides and Proteins*, Oxford University Press, New York: 1998, the entire contents of which are incorporated herein by reference). The Mmt protecting groups of the peptidomimetic precursor are then selectively cleaved by standard conditions (e.g., mild acid such as 1% TFA in DCM). The precursor peptidomimetic is then reacted on the resin with X-L₂-Y in an organic solution. For example, the reaction takes place in the presence of a hindered base such as diisopropylethylamine. In some embodiments, the alkylation reaction is performed in organic solutions such as liquid NH₃ (Mosberg et al. (1985), *J. Am. Chem. Soc.* 107:2986-2987; Szewczuk et al. (1992), *Int. J. Peptide Protein Res.* 40: 233-242), NH₃/MeOH or NH₃/DMF (Or et al. (1991), *J. Org. Chem.* 56:3146-3149). In other embodiments, the alkylation reaction is performed in DMF or dichloroethane. The peptidomimetic macrocycle is then deprotected and cleaved from the solid-phase resin by standard conditions (e.g., strong acid such as 95% TFA).

Synthetic Scheme 8:

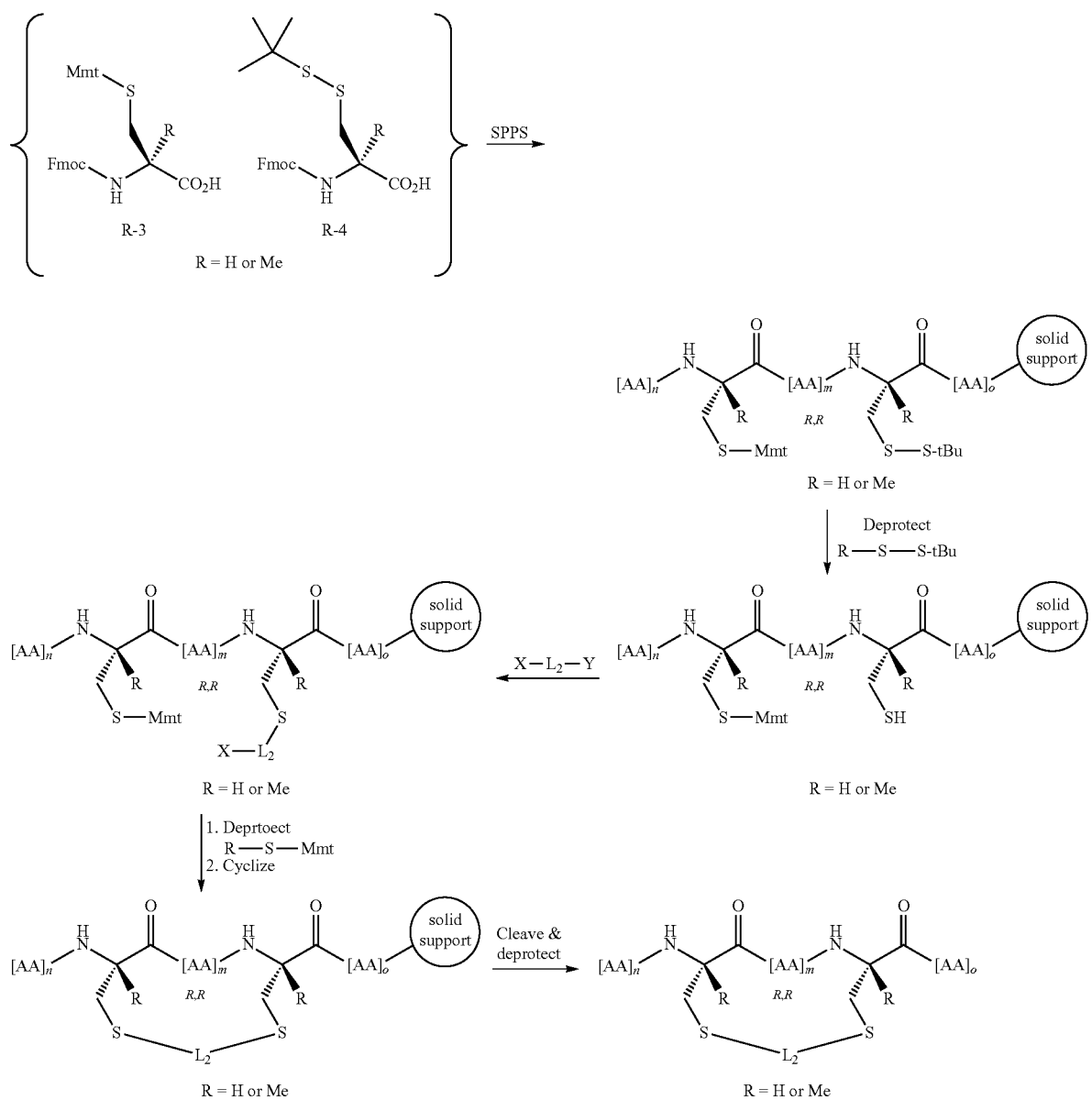

In Scheme 8, the peptidomimetic precursor contains two or more —SH moieties, of which two are specially protected to allow their selective deprotection and subsequent alkylation for macrocycle formation. The peptidomimetic precursor is synthesized by solid-phase peptide synthesis (SPPS) using commercially available N-α-Fmoc amino acids such as N-α-Fmoc-S-p-methoxytrityl-L-cysteine, N-α-Fmoc-S-p-methoxytrityl-D-cysteine, N-α-Fmoc-S—S-t-butyl-L-cysteine, and N-α-Fmoc-S—S-t-butyl-D-cysteine. Alpha-methylated versions of D-cysteine or L-cysteine are generated by known methods (Seebach et al. (1996), *Angew. Chem. Int. Ed. Engl.* 35:2708-2748, and references therein) and then converted to the appropriately protected N-α-Fmoc-S-p-methoxytrityl or N-α-Fmoc-S—S-t-butyl monomers by known methods (*Bioorganic Chemistry: Peptides and Proteins*, Oxford University Press, New York: 1998, the entire contents of which are incorporated herein by reference). The S—S-tButyl protecting group of the peptidomimetic precursor is selectively cleaved by known conditions (e.g., 20% 2-mercaptoethanol in DMF, reference: Galande et al. (2005), *J. Comb. Chem.* 7:174-177). The precursor peptidomimetic is then reacted on the resin with a molar excess of X-$L_2$-Y in an organic solution. For example, the reaction takes place in the presence of a hindered base such as diisopropylethylamine. The Mmt protecting group of the peptidomimetic precursor is then selectively cleaved by standard conditions (e.g., mild acid such as 1% TFA in DCM). The peptidomimetic precursor is then cyclized on the resin by treatment with a hindered base in organic solutions. In some embodiments, the alkylation reaction is performed in organic solutions such as $NH_3$/MeOH or $NH_3$/DMF (Or et al. (1991), *J. Org. Chem.* 56:3146-3149). The peptidomimetic macrocycle is then deprotected and cleaved from the solid-phase resin by standard conditions (e.g., strong acid such as 95% TFA).

Synthetic Scheme 9:

1. Biological synthesis of peptide
2. Purification of peptide

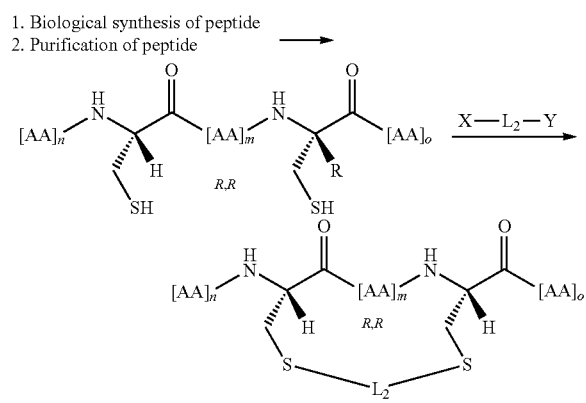

In Scheme 9, the peptidomimetic precursor contains two L-cysteine moieties. The peptidomimetic precursor is synthesized by known biological expression systems in living cells or by known in vitro, cell-free, expression methods. The precursor peptidomimetic is reacted as a crude mixture or is purified prior to reaction with X-L2-Y in organic or aqueous solutions. In some embodiments the alkylation reaction is performed under dilute conditions (i.e. 0.15 mmol/L) to favor macrocyclization and to avoid polymerization. In some embodiments, the alkylation reaction is performed in organic solutions such as liquid $NH_3$ (Mosberg et al. (1985), J. Am. Chem. Soc. 107:2986-2987; Szewczuk et al. (1992), Int. J. Peptide Protein Res. 40: 233-242), $NH_3$/MeOH, or $NH_3$/DMF (Or et al. (1991), J. Org. Chem. 56:3146-3149). In other embodiments, the alkylation is performed in an aqueous solution such as 6M guanidinium HCL, pH 8 (Brunel et al. (2005), Chem. Commun (20):2552-2554). In other embodiments, the alkylation is performed in DMF or dichloroethane. In another embodiment, the alkylation is performed in non-denaturing aqueous solutions, and in yet another embodiment the alkylation is performed under conditions that favor α-helical structure formation. In yet another embodiment, the alkylation is performed under conditions that favor the binding of the precursor peptidomimetic to another protein, so as to induce the formation of the bound α-helical conformation during the alkylation.

Various embodiments for X and Y are envisioned which are suitable for reacting with thiol groups. In general, each X or Y is independently be selected from the general category shown in Table 2. For example, X and Y are halides such as —Cl, —Br or —I. Any of the macrocycle-forming linkers described herein may be used in any combination with any of the sequences shown and also with any of the R-substituents indicated herein.

TABLE 2

Examples of Reactive Groups Capable of Reacting with Thiol Groups and Resulting Linkages

| X or Y | Resulting Covalent Linkage |
| --- | --- |
| acrylamide | Thioether |
| halide (e.g. alkyl or aryl halide) | Thioether |
| sulfonate | Thioether |
| aziridine | Thioether |
| epoxide | Thioether |

TABLE 2-continued

Examples of Reactive Groups Capable of Reacting with Thiol Groups and Resulting Linkages

| X or Y | Resulting Covalent Linkage |
| --- | --- |
| haloacetamide | Thioether |
| maleimide | Thioether |
| sulfonate ester | Thioether |

The present invention contemplates the use of both naturally-occurring and non-naturally-occurring amino acids and amino acid analogs in the synthesis of the peptidomimetic macrocycles of Formula II. Any amino acid or amino acid analog amenable to the synthetic methods employed for the synthesis of stable bis-sulfhydryl containing peptidomimetic macrocycles can be used in the present invention. For example, cysteine is contemplated as a useful amino acid in the present invention. However, sulfur containing amino acids other than cysteine that contain a different amino acid side chain are also useful. For example, cysteine contains one methylene unit between the α-carbon of the amino acid and the terminal —SH of the amino acid side chain. The invention also contemplates the use of amino acids with multiple methylene units between the α-carbon and the terminal —SH. Non-limiting examples include α-methyl-L-homocysteine and α-methyl-D-homocysteine. In some embodiments the amino acids and amino acid analogs are of the D-configuration. In other embodiments they are of the L-configuration. In some embodiments, some of the amino acids and amino acid analogs contained in the peptidomimetic are of the D-configuration while some of the amino acids and amino acid analogs are of the L-configuration. In some embodiments the amino acid analogs are α,α-disubstituted, such as α-methyl-L-cysteine and α-methyl-D-cysteine.

The invention includes macrocycles in which macrocycle-forming linkers are used to link two or more —SH moieties in the peptidomimetic precursors to form the peptidomimetic macrocycles disclosed herein. As described above, the macrocycle-forming linkers impart conformational rigidity, increased metabolic stability and/or increased cell penetrability. Furthermore, in some embodiments, the macrocycle-forming linkages stabilize the α-helical secondary structure of the peptidomimetic macrocycles. The macrocycle-forming linkers are of the formula X-$L_2$-Y, wherein both X and Y are the same or different moieties, as defined above. Both X and Y have the chemical characteristics that allow one macrocycle-forming linker -$L_2$- to bis alkylate the bis-sulfhydryl containing peptidomimetic precursor. As defined above, the linker -$L_2$- includes alkylene, alkenylene, alkynylene, heteroalkylene, cycloalkylene, heterocycloalkylene, cycloarylene, or heterocycloarylene, or —$R_4$—K—$R_4$—, all of which can be optionally substituted with an $R_5$ group, as defined above. Furthermore, one to three carbon atoms within the macrocycle-forming linkers -$L_2$-, other than the carbons attached to the —SH of the sulfhydryl containing amino acid, are optionally substituted with a heteroatom such as N, S or O.

The $L_2$ component of the macrocycle-forming linker X-$L_2$-Y may be varied in length depending on, among other things, the distance between the positions of the two amino acid analogs used to form the peptidomimetic macrocycle. Furthermore, as the lengths of $L_1$ and/or $L_3$ components of the macrocycle-forming linker are varied, the length of $L_2$ can also be varied in order to create a linker of appropriate overall length for forming a stable peptidomimetic macrocycle. For example, if the amino acid analogs used are varied by adding an additional methylene unit to each of $L_1$ and $L_3$, the length of $L_2$ are decreased in length by the equivalent of approximately two methylene units to compensate for the increased lengths of $L_1$ and $L_3$.

In some embodiments, $L_2$ is an alkylene group of the formula —$(CH_2)_n$—, where n is an integer between about 1 and about 15. For example, n is 1, 2, 3, 4, 5, 6, 7, 8, 9 or 10. In other embodiments, $L_2$ is an alkenylene group. In still other embodiments, $L_2$ is an aryl group.

Table 3 shows additional embodiments of X-$L_2$-Y groups.

TABLE 3

Exemplary X—$L_2$—Y groups.

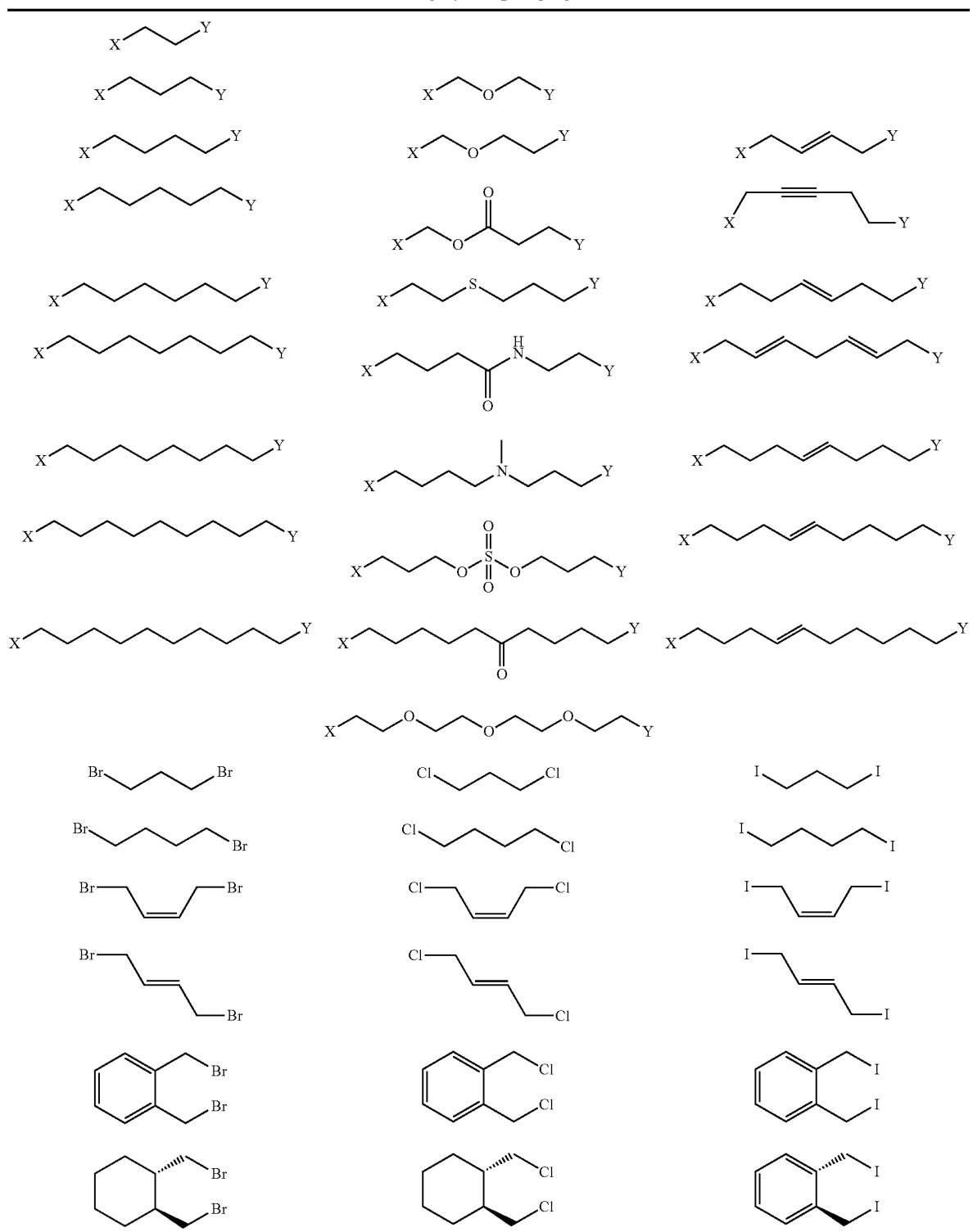

TABLE 3-continued

Exemplary X—L₂—Y groups.

[Structures shown: BEB, Bph, Bpy]

Each X and Y in this table, is, for example, independently Cl—, Br— or I—.

Additional methods of forming peptidomimetic macrocycles which are envisioned as suitable include those disclosed by Mustapa, M. Firouz Mohd et al., J. Org. Chem (2003), 68, pp. 8193-8198; Yang, Bin et al. Bioorg Med. Chem. Lett. (2004), 14, pp. 1403-1406; U.S. Pat. No. 5,364,851; U.S. Pat. No. 5,446,128; U.S. Pat. No. 5,824,483; U.S. Pat. No. 6,713,280; and U.S. Pat. No. 7,202,332. In such embodiments, aminoacid precursors are used containing an additional substituent R— at the alpha position. Such aminoacids are incorporated into the macrocycle precursor at the desired positions, which can be at the positions where the crosslinker is substituted or, alternatively, elsewhere in the sequence of the macrocycle precursor. Cyclization of the precursor is then effected according to the indicated method.

In some embodiments, the —NH moiety of the amino acid is protected using a protecting group, including without limitation -Fmoc and -Boc. In other embodiments, the amino acid is not protected prior to synthesis of the peptidomimetic macrocycle.

Assays

The properties of peptidomimetic macrocycles are assayed, for example, by using the methods described below. In some embodiments, a peptidomimetic macrocycle has improved biological properties relative to a corresponding polypeptide lacking the substituents described herein.

Assay to Determine α-Helicity

In solution, the secondary structure of polypeptides with α-helical domains will reach a dynamic equilibrium between random coil structures and α-helical structures, often expressed as a "percent helicity". Thus, for example, alpha-helical domains are predominantly random coils in solution, with α-helical content usually under 25%. Peptidomimetic macrocycles with optimized linkers, on the other hand, possess, for example, an alpha-helicity that is at least two-fold greater than that of a corresponding uncrosslinked polypeptide. In some embodiments, macrocycles will possess an alpha-helicity of greater than 50%. To assay the helicity of peptidomimetic macrocycles, the compounds are dissolved in an aqueous solution (e.g. 50 mM potassium phosphate solution at pH 7, or distilled H₂O, to concentrations of 25-50 µM). Circular dichroism (CD) spectra are obtained on a spectropolarimeter (e.g., Jasco J-710) using standard measurement parameters (e.g. temperature, 20° C.; wavelength, 190-260 nm; step resolution, 0.5 nm; speed, 20 nm/sec; accumulations, 10; response, 1 sec; bandwidth, 1 nm; path length, 0.1 cm). The α-helical content of each peptide is calculated by dividing the mean residue ellipticity (e.g. [Φ]222obs) by the reported value for a model helical decapeptide (Yang et al. (1986), Methods Enzymol. 130:208)).

Assay to Determine Melting Temperature (Tm).

A peptidomimetic macrocycle comprising a secondary structure such as an α-helix exhibits, for example, a higher melting temperature than a corresponding uncrosslinked polypeptide. Typically peptidomimetic macrocycles exhibit Tm of >60° C. representing a highly stable structure in aqueous solutions. To assay the effect of macrocycle formation on melting temperature, peptidomimetic macrocycles or unmodified peptides are dissolved in distilled H₂O (e.g. at a final concentration of 50 µM) and the Tm is determined by measuring the change in ellipticity over a temperature range (e.g. 4 to 95° C.) on a spectropolarimeter (e.g., Jasco J-710) using standard parameters (e.g. wavelength 222 nm; step resolution, 0.5 nm; speed, 20 nm/sec; accumulations, 10; response, 1 sec; bandwidth, 1 nm; temperature increase rate: 1° C./min; path length, 0.1 cm).

Protease Resistance Assay.

The amide bond of the peptide backbone is susceptible to hydrolysis by proteases, thereby rendering peptidic compounds vulnerable to rapid degradation in vivo. Peptide helix formation, however, typically buries the amide backbone and therefore can shield it from proteolytic cleavage. The peptidomimetic macrocycles can be subjected to in vitro trypsin proteolysis to assess for any change in degradation rate compared to a corresponding uncrosslinked polypeptide. For example, the peptidomimetic macrocycle and a corresponding uncrosslinked polypeptide are incubated with trypsin agarose and the reactions quenched at various time points by centrifugation and subsequent HPLC injection to quantitate the residual substrate by ultraviolet absorption at 280 nm. Briefly, the peptidomimetic macrocycle and peptidomimetic precursor (5 mcg) are incubated with trypsin agarose (Pierce) (S/E ~125) for 0, 10, 20, 90, and 180 minutes. Reactions are quenched by tabletop centrifugation at high speed; remaining substrate in the isolated supernatant is quantified by HPLC-based peak detection at 280 nm. The proteolytic reaction displays first order kinetics and the rate constant, k, is determined from a plot of ln [S] versus time (k=−1× slope).

Ex Vivo Stability Assay.

Peptidomimetic macrocycles with optimized linkers possess, for example, an ex vivo half-life that is at least two-fold greater than that of a corresponding uncrosslinked polypeptide, and possess an ex vivo half-life of 12 hours or more. For ex vivo serum stability studies, a variety of assays can be used. For example, a peptidomimetic macrocycle and a corresponding uncrosslinked polypeptide (2 mcg) are incubated with fresh mouse, rat and/or human serum (2 mL) at 37° C. for 0, 1, 2, 4, 8, and 24 hours. To determine the level of intact compound, the following procedure can be used: The samples are extracted by transferring 100 µl of sera to 2 ml centrifuge tubes followed by the addition of 10 µL of 50% formic acid and 500 µL acetonitrile and centrifugation at 14,000 RPM for 10 min at 4±2° C. The supernatants are then transferred to fresh 2 ml tubes and evaporated on Turbovap under $N_2$<10 psi, 37° C. The samples are reconstituted in 100 µL of 50:50 acetonitrile:water and submitted to LC-MS/MS analysis.

In Vitro Binding Assays.

To assess the binding and affinity of peptidomimetic macrocycles and peptidomimetic precursors to acceptor proteins, a fluorescence polarization assay (FPA) is used, for example. The FPA technique measures the molecular orientation and mobility using polarized light and fluorescent tracer. When excited with polarized light, fluorescent tracers (e.g., FITC) attached to molecules with high apparent molecular weights (e.g. FITC-labeled peptides bound to a large protein) emit higher levels of polarized fluorescence due to their slower rates of rotation as compared to fluorescent tracers attached to smaller molecules (e.g. FITC-labeled peptides that are free in solution).

For example, fluoresceinated peptidomimetic macrocycles (25 nM) are incubated with the acceptor protein (25-1000 nM) in binding buffer (140 mM NaCl, 50 mM Tris-HCL, pH 7.4) for 30 minutes at room temperature. Binding activity is measured, for example, by fluorescence polarization on a luminescence spectrophotometer (e.g. Perkin-Elmer LS50B). Kd values can be determined by nonlinear regression analysis using, for example, Graphpad Prism software (GraphPad Software, Inc., San Diego, Calif.). A peptidomimetic macrocycle shows, In some embodiments, similar or lower Kd than a corresponding uncrosslinked polypeptide.

In Vitro Displacement Assays to Characterize Antagonists of Peptide-Protein Interactions.

To assess the binding and affinity of compounds that antagonize the interaction between a peptide and an acceptor protein, a fluorescence polarization assay (FPA) utilizing a fluoresceinated peptidomimetic macrocycle derived from a peptidomimetic precursor sequence is used, for example. The FPA technique measures the molecular orientation and mobility using polarized light and fluorescent tracer. When excited with polarized light, fluorescent tracers (e.g., FITC) attached to molecules with high apparent molecular weights (e.g. FITC-labeled peptides bound to a large protein) emit higher levels of polarized fluorescence due to their slower rates of rotation as compared to fluorescent tracers attached to smaller molecules (e.g. FITC-labeled peptides that are free in solution). A compound that antagonizes the interaction between the fluoresceinated peptidomimetic macrocycle and an acceptor protein will be detected in a competitive binding FPA experiment.

For example, putative antagonist compounds (1 nM to 1 mM) and a fluoresceinated peptidomimetic macrocycle (25 nM) are incubated with the acceptor protein (50 nM) in binding buffer (140 mM NaCl, 50 mM Tris-HCL, pH 7.4) for 30 minutes at room temperature. Antagonist binding activity is measured, for example, by fluorescence polarization on a luminescence spectrophotometer (e.g. Perkin-Elmer LS50B). Kd values can be determined by nonlinear regression analysis using, for example, Graphpad Prism software (GraphPad Software, Inc., San Diego, Calif.).

Any class of molecule, such as small organic molecules, peptides, oligonucleotides or proteins can be examined as putative antagonists in this assay.

Assay for Protein-Ligand Binding by Affinity Selection-Mass Spectrometry

To assess the binding and affinity of test compounds for proteins, an affinity-selection mass spectrometry assay is used, for example. Protein-ligand binding experiments are conducted according to the following representative procedure outlined for a system-wide control experiment using 1 µM peptidomimetic macrocycle plus 5 µM hMDM2. A 1 µL DMSO aliquot of a 40 µM stock solution of peptidomimetic macrocycle is dissolved in 19 µL of PBS (Phosphate-buffered saline: 50 mM, pH 7.5 Phosphate buffer containing 150 mM NaCl). The resulting solution is mixed by repeated pipetting and clarified by centrifugation at 10 000 g for 10 min. To a 4 µL aliquot of the resulting supernatant is added 4 µL of 10 µM hMDM2 in PBS. Each 8.0 µL experimental sample thus contains 40 pmol (1.5 µg) of protein at 5.0 µM concentration in PBS plus 1 µM peptidomimetic macrocycle and 2.5% DMSO. Duplicate samples thus prepared for each concentration point are incubated for 60 min at room temperature, and then chilled to 4° C. prior to size-exclusion chromatography-LC-MS analysis of 5.0 µL injections. Samples containing a target protein, protein-ligand complexes, and unbound compounds are injected onto an SEC column, where the complexes are separated from non-binding component by a rapid SEC step. The SEC column eluate is monitored using UV detectors to confirm that the early-eluting protein fraction, which elutes in the void volume of the SEC column, is well resolved from unbound components that are retained on the column. After the peak containing the protein and protein-ligand complexes elutes from the primary UV detector, it enters a sample loop where it is excised from the flow stream of the SEC stage and transferred directly to the LC-MS via a valving mechanism. The $(M+3H)^{3+}$ ion of the peptidomimetic macrocycle is observed by ESI-MS at the expected m/z, confirming the detection of the protein-ligand complex.

Assay for Protein-Ligand Kd Titration Experiments.

To assess the binding and affinity of test compounds for proteins, a protein-ligand Kd titration experiment is performed, for example. Protein-ligand $K_d$ titrations experiments are conducted as follows: 2 µL DMSO aliquots of a serially diluted stock solution of titrant peptidomimetic macrocycle (5, 2.5, ..., 0.098 mM) are prepared then dissolved in 38 µL of PBS. The resulting solutions are mixed by repeated pipetting and clarified by centrifugation at 10 000 g for 10 min. To 4.0 µL aliquots of the resulting supernatants is added 4.0 µL of 10 µM hMDM2 in PBS. Each 8.0 µL experimental sample thus contains 40 pmol (1.5 µg) of protein at 5.0 µM concentration in PBS, varying concentrations (125, 62.5, ..., 0.24 µM) of the titrant peptide, and 2.5% DMSO. Duplicate samples thus prepared for each concentration point are incubated at room temperature for 30 min, then chilled to 4° C. prior to SEC-LC-MS analysis of 2.0 µL injections. The $(M+H)^{1+}$, $(M+2H)^{2+}$, $(M+3H)^{3+}$, and/or $(M+Na)^{1+}$ ion is observed by ESI-MS; extracted ion chromatograms are quantified, then fit to equations to derive the binding affinity $K_d$ as described in "*A General Technique to Rank Protein-Ligand Binding Affinities and Determine Allosteric vs. Direct Binding Site Competition in Compound Mixtures*." Annis, D. A.; Nazef, N.; Chuang, C. C.; Scott, M. P.; Nash, H. M. *J. Am. Chem. Soc.* 2004, 126, 15495-15503; also in "*ALIS: An Affinity Selection-Mass Spectrometry System for the Discovery and Characterization of Protein-Ligand Interactions*" D. A. Annis, C.-C. Chuang, and N. Nazef. In Mass Spectrometry in Medicinal Chemistry. Edited by Wanner K, Höfner G: Wiley- VCH; 2007:121-184. Mannhold R, Kubinyi H, Folkers G (Series Editors): Methods and Principles in Medicinal Chemistry.

Assay for Competitive Binding Experiments by Affinity Selection-Mass Spectrometry To determine the ability of test compounds to bind competitively to proteins, an affinity selection mass spectrometry assay is performed, for example. A mixture of ligands at 40 µM per component is prepared by combining 2 µL aliquots of 400 µM stocks of each of the three compounds with 14 µL of DMSO. Then, 1 µL aliquots of this 40 µM per component mixture are combined with 1 µL DMSO aliquots of a serially diluted stock solution of titrant peptidomimetic macrocycle (10, 5, 2.5, . . . , 0.078 mM). These 2 µL samples are dissolved in 38 µL of PBS. The resulting solutions were mixed by repeated pipetting and clarified by centrifugation at 10 000 g for 10 min. To 4.0 µL aliquots of the resulting supernatants is added 4.0 µL of 10 µM hMDM2 protein in PBS. Each 8.0 µL experimental sample thus contains 40 pmol (1.5 µg) of protein at 5.0 µM concentration in PBS plus 0.5 µM ligand, 2.5% DMSO, and varying concentrations (125, 62.5, . . . , 0.98 µM) of the titrant peptidomimetic macrocycle. Duplicate samples thus prepared for each concentration point are incubated at room temperature for 60 min, then chilled to 4° C. prior to SEC-LC-MS analysis of 2.0 µL injections. Additional details on these and other methods are provided in "*A General Technique to Rank Protein-Ligand Binding Affinities and Determine Allosteric vs. Direct Binding Site Competition in Compound Mixtures*." Annis, D. A.; Nazef, N.; Chuang, C. C.; Scott, M. P.; Nash, H. M. *J. Am. Chem. Soc.* 2004, 126, 15495-15503; also in "*ALIS: An Affinity Selection-Mass Spectrometry System for the Discovery and Characterization of Protein-Ligand Interactions*" D. A. Annis, C.-C. Chuang, and N. Nazef. In Mass Spectrometry in Medicinal Chemistry. Edited by Wanner K, Höfner G: Wiley-VCH; 2007:121-184. Mannhold R, Kubinyi H, Folkers G (Series Editors): Methods and Principles in Medicinal Chemistry.

Binding Assays in Intact Cells.

It is possible to measure binding of peptides or peptidomimetic macrocycles to their natural acceptors in intact cells by immunoprecipitation experiments. For example, intact cells are incubated with fluoresceinated (FITC-labeled) compounds for 4 hrs in the absence of serum, followed by serum replacement and further incubation that ranges from 4-18 hrs. Cells are then pelleted and incubated in lysis buffer (50 mM Tris [pH 7.6], 150 mM NaCl, 1% CHAPS and protease inhibitor cocktail) for 10 minutes at 4° C. Extracts are centrifuged at 14,000 rpm for 15 minutes and supernatants collected and incubated with 10 µl goat anti-FITC antibody for 2 hrs, rotating at 4° C. followed by further 2 hrs incubation at 4° C. with protein A/G Sepharose (50 µl of 50% bead slurry). After quick centrifugation, the pellets are washed in lysis buffer containing increasing salt concentration (e.g., 150, 300, 500 mM). The beads are then re-equilibrated at 150 mM NaCl before addition of SDS-containing sample buffer and boiling. After centrifugation, the supernatants are optionally electrophoresed using 4%-12% gradient Bis-Tris gels followed by transfer into Immobilon-P membranes. After blocking, blots are optionally incubated with an antibody that detects FITC and also with one or more antibodies that detect proteins that bind to the peptidomimetic macrocycle.

Cellular Penetrability Assays.

A peptidomimetic macrocycle is, for example, more cell penetrable compared to a corresponding uncrosslinked macrocycle. Peptidomimetic macrocycles with optimized linkers possess, for example, cell penetrability that is at least two-fold greater than a corresponding uncrosslinked macrocycle, and often 20% or more of the applied peptidomimetic macrocycle will be observed to have penetrated the cell after 4 hours. To measure the cell penetrability of peptidomimetic macrocycles and corresponding uncrosslinked macrocycle, intact cells are incubated with fluorescently-labeled (e.g. fluoresceinated) peptidomimetic macrocycles or corresponding uncrosslinked macrocycle (10 µM) for 4 hrs in serum free media at 37° C., washed twice with media and incubated with trypsin (0.25%) for 10 min at 37° C. The cells are washed again and resuspended in PBS. Cellular fluorescence is analyzed, for example, by using either a FACSCalibur flow cytometer or Cellomics' KineticScan® HCS Reader.

Cellular Efficacy Assays.

The efficacy of certain peptidomimetic macrocycles is determined, for example, in cell-based killing assays using a variety of tumorigenic and non-tumorigenic cell lines and primary cells derived from human or mouse cell populations. Cell viability is monitored, for example, over 24-96 hrs of incubation with peptidomimetic macrocycles (0.5 to 50 µM) to identify those that kill at $EC_{50}<10$ µM. Several standard assays that measure cell viability are commercially available and are optionally used to assess the efficacy of the peptidomimetic macrocycles. In addition, assays that measure Annexin V and caspase activation are optionally used to assess whether the peptidomimetic macrocycles kill cells by activating the apoptotic machinery. For example, the Cell Titer-glo assay is used which determines cell viability as a function of intracellular ATP concentration.

In Vivo Stability Assay.

To investigate the in vivo stability of the peptidomimetic macrocycles, the compounds are, for example, administered to mice and/or rats by IV, IP, PO or inhalation routes at concentrations ranging from 0.1 to 50 mg/kg and blood specimens withdrawn at 0', 5', 15', 30', 1 hr, 4 hrs, 8 hrs and 24 hours post-injection. Levels of intact compound in 25 µL of fresh serum are then measured by LC-MS/MS as above.

In Vivo Efficacy in Animal Models.

To determine the anti-oncogenic activity of peptidomimetic macrocycles in vivo, the compounds are, for example, given alone (IP, IV, PO, by inhalation or nasal routes) or in combination with sub-optimal doses of relevant chemotherapy (e.g., cyclophosphamide, doxorubicin, etoposide). In one example, $5\times10^6$ RS4;11 cells (established from the bone marrow of a patient with acute lymphoblastic leukemia) that stably express luciferase are injected by tail vein in NOD-SCID mice 3 hrs after they have been subjected to total body irradiation. If left untreated, this form of leukemia is fatal in 3 weeks in this model. The leukemia is readily monitored, for example, by injecting the mice with D-luciferin (60 mg/kg) and imaging the anesthetized animals (e.g., Xenogen In Vivo Imaging System, Caliper Life Sciences, Hopkinton, Mass.). Total body bioluminescence is quantified by integration of photonic flux (photons/sec) by Living Image Software (Caliper Life Sciences, Hopkinton, Mass.). Peptidomimetic macrocycles alone or in combination with sub-optimal doses of relevant chemotherapeutics agents are, for example, administered to leukemic mice (10 days after injection/day 1 of experiment, in bioluminescence range of 14-16) by tail vein or IP routes at doses ranging from 0.1 mg/kg to 50 mg/kg for 7 to 21 days. Optionally, the mice are imaged throughout the experiment every other day and survival monitored daily for the duration of the experiment. Expired mice are optionally subjected to necropsy at the end of the experiment. Another animal model is implantation into NOD-SCID mice of DoHH2, a cell line derived from human follicular lymphoma, that stably expresses luciferase. These in vivo tests optionally generate preliminary pharmacokinetic, pharmacodynamic and toxicology data.

Clinical Trials.

To determine the suitability of the peptidomimetic macrocycles for treatment of humans, clinical trials are performed. For example, patients diagnosed with cancer and in need of treatment can be selected and separated in treatment and one or more control groups, wherein the treatment group is administered a peptidomimetic macrocycle, while the control groups receive a placebo or a known anti-cancer drug. The treatment safety and efficacy of the peptidomimetic macrocycles can thus be evaluated by performing comparisons of the patient groups with respect to factors such as survival and quality-of-life. In this example, the patient group treated with a peptidomimetic macrocycle can show improved long-term survival compared to a patient control group treated with a placebo.

Pharmaceutical Compositions and Routes of Administration

Pharmaceutical compositions disclosed herein include peptidomimetic macrocycles and pharmaceutically acceptable derivatives or prodrugs thereof. A "pharmaceutically acceptable derivative" means any pharmaceutically acceptable salt, ester, salt of an ester, pro-drug or other derivative of a compound disclosed herein which, upon administration to a recipient, is capable of providing (directly or indirectly) a compound disclosed herein. Particularly favored pharmaceutically acceptable derivatives are those that increase the bioavailability of the compounds when administered to a mammal (e.g., by increasing absorption into the blood of an orally administered compound) or which increases delivery of the active compound to a biological compartment (e.g., the brain or lymphatic system) relative to the parent species. Some pharmaceutically acceptable derivatives include a chemical group which increases aqueous solubility or active transport across the gastrointestinal mucosa.

In some embodiments, peptidomimetic macrocycles are modified by covalently or non-covalently joining appropriate functional groups to enhance selective biological properties. Such modifications include those which increase biological penetration into a given biological compartment (e.g., blood, lymphatic system, central nervous system), increase oral availability, increase solubility to allow administration by injection, alter metabolism, and alter rate of excretion.

Pharmaceutically acceptable salts of the compounds disclosed herein include those derived from pharmaceutically acceptable inorganic and organic acids and bases. Examples of suitable acid salts include acetate, adipate, benzoate, benzenesulfonate, butyrate, citrate, digluconate, dodecylsulfate, formate, fumarate, glycolate, hemisulfate, heptanoate, hexanoate, hydrochloride, hydrobromide, hydroiodide, lactate, maleate, malonate, methanesulfonate, 2-naphthalenesulfonate, nicotinate, nitrate, palmoate, phosphate, picrate, pivalate, propionate, salicylate, succinate, sulfate, tartrate, tosylate and undecanoate. Salts derived from appropriate bases include alkali metal (e.g., sodium), alkaline earth metal (e.g., magnesium), ammonium and N-(alkyl)$_4^+$ salts.

For preparing pharmaceutical compositions from the compounds provided herein, pharmaceutically acceptable carriers include either solid or liquid carriers. Solid form preparations include powders, tablets, pills, capsules, cachets, suppositories, and dispersible granules. A solid carrier can be one or more substances, which also acts as diluents, flavoring agents, binders, preservatives, tablet disintegrating agents, or an encapsulating material. Details on techniques for formulation and administration are well described in the scientific and patent literature, see, e.g., the latest edition of Remington's Pharmaceutical Sciences, Maack Publishing Co, Easton Pa.

In powders, the carrier is a finely divided solid, which is in a mixture with the finely divided active component. In tablets, the active component is mixed with the carrier having the necessary binding properties in suitable proportions and compacted in the shape and size desired.

Suitable solid excipients are carbohydrate or protein fillers include, but are not limited to, sugars, including lactose, sucrose, mannitol, or sorbitol; starch from corn, wheat, rice, potato, or other plants; cellulose such as methyl cellulose, hydroxypropylmethyl-cellulose, or sodium carboxymethylcellulose; and gums including arabic and tragacanth; as well as proteins such as gelatin and collagen. If desired, disintegrating or solubilizing agents are added, such as the cross-linked polyvinyl pyrrolidone, agar, alginic acid, or a salt thereof, such as sodium alginate.

Liquid form preparations include, without limitation, solutions, suspensions, and emulsions, for example, water or water/propylene glycol solutions. For parenteral injection, liquid preparations can be formulated in solution in aqueous polyethylene glycol solution.

The pharmaceutical preparation can be in unit dosage form. In such form the preparation is subdivided into unit doses containing appropriate quantities of the active component. The unit dosage form can be a packaged preparation, the package containing discrete quantities of preparation, such as packeted tablets, capsules, and powders in vials or ampoules. Also, the unit dosage form can be a capsule, tablet, cachet, or lozenge itself, or it can be the appropriate number of any of these in packaged form.

When one or more compositions disclosed herein comprise a combination of a peptidomimetic macrocycle and one or more additional therapeutic or prophylactic agents, both the compound and the additional agent should be present at dosage levels of between about 1 to 100%, and more preferably between about 5 to 95% of the dosage normally administered in a monotherapy regimen. In some embodiments, the additional agents are administered separately, as part of a multiple dose regimen, from one or more compounds disclosed herein. Alternatively, those agents are part of a single dosage form, mixed together with one or more compounds disclosed herein in a single composition.

Methods of Use

In one aspect, provided herein are novel peptidomimetic macrocycles that are useful in competitive binding assays to identify agents which bind to the natural ligand(s) of the proteins or peptides upon which the peptidomimetic macrocycles are modeled. For example, in the p53/MDMX system, labeled peptidomimetic macrocycles based on p53 can be used in a MDMX binding assay along with small molecules that competitively bind to MDMX. Competitive binding studies allow for rapid in vitro evaluation and determination of drug candidates specific for the p53/MDMX system. Such binding studies can be performed with any of the peptidomimetic macrocycles disclosed herein and their binding partners.

Provided herein is the generation of antibodies against the peptidomimetic macrocycles. In some embodiments, these antibodies specifically bind both the peptidomimetic macrocycle and the precursor peptides, such as p53, to which the peptidomimetic macrocycles are related. Such antibodies, for example, disrupt the native protein-protein interaction, for example, binding between p53 and MDMX.

In other aspects, provided herein are both prophylactic and therapeutic methods of treating a subject at risk of (or susceptible to) a disorder or having a disorder associated with aberrant (e.g., insufficient or excessive) expression or activity of the molecules including p53, MDM2 or MDMX.

In another embodiment, a disorder is caused, at least in part, by an abnormal level of p53 or MDM2 or MDMX, (e.g., over or under expression), or by the presence of p53 or MDM2 or MDMX exhibiting abnormal activity. As such, the reduction in the level and/or activity of p53 or MDM2 or MDMX, or the enhancement of the level and/or activity of p53 or MDM2 or MDMX, by peptidomimetic macrocycles derived from p53, is used, for example, to ameliorate or reduce the adverse symptoms of the disorder.

In another aspect, provided herein are methods for treating or preventing a disease including hyperproliferative disease and inflammatory disorder by interfering with the interaction or binding between binding partners, for example, between p53 and MDM2 or p53 and MDMX. These methods comprise administering an effective amount of a compound to a warm blooded animal, including a human. In some embodiments, the administration of one or more compounds disclosed herein induces cell growth arrest or apoptosis.

As used herein, the term "treatment" is defined as the application or administration of a therapeutic agent to a patient, or application or administration of a therapeutic agent to an isolated tissue or cell line from a patient, who has a disease, a symptom of disease or a predisposition toward a disease, with the purpose to cure, heal, alleviate, relieve, alter, remedy, ameliorate, improve or affect the disease, the symptoms of disease or the predisposition toward disease.

In some embodiments, the peptidomimetics macrocycles can be used to treat, prevent, and/or diagnose cancers and neoplastic conditions. As used herein, the terms "cancer", "hyperproliferative" and "neoplastic" refer to cells having the capacity for autonomous growth, i.e., an abnormal state or condition characterized by rapidly proliferating cell growth. Hyperproliferative and neoplastic disease states can be categorized as pathologic, i.e., characterizing or constituting a disease state, or can be categorized as non-pathologic, i.e., a deviation from normal but not associated with a disease state. The term is meant to include all types of cancerous growths or oncogenic processes, metastatic tissues or malignantly transformed cells, tissues, or organs, irrespective of histopathologic type or stage of invasiveness. A metastatic tumor can arise from a multitude of primary tumor types, including but not limited to those of breast, lung, liver, colon and ovarian origin. "Pathologic hyperproliferative" cells occur in disease states characterized by malignant tumor growth. Examples of non-pathologic hyperproliferative cells include proliferation of cells associated with wound repair. Examples of cellular proliferative and/or differentiative disorders include cancer, e.g., carcinoma, sarcoma, or metastatic disorders. In some embodiments, the peptidomimetics macrocycles are novel therapeutic agents for controlling breast cancer, ovarian cancer, colon cancer, lung cancer, metastasis of such cancers and the like.

Examples of cancers or neoplastic conditions include, but are not limited to, a fibrosarcoma, myosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, gastric cancer, esophageal cancer, rectal cancer, pancreatic cancer, ovarian cancer, prostate cancer, uterine cancer, cancer of the head and neck, skin cancer, brain cancer, squamous cell carcinoma, sebaceous gland carcinoma, papillary carcinoma, papillary adenocarcinoma, cystadenocarcinoma, medullary carcinoma, bronchogenic carcinoma, renal cell carcinoma, hepatoma, bile duct carcinoma, choriocarcinoma, seminoma, embryonal carcinoma, Wilm's tumor, cervical cancer, testicular cancer, small cell lung carcinoma, non-small cell lung carcinoma, bladder carcinoma, epithelial carcinoma, glioma, astrocytoma, medulloblastoma, craniopharyngioma, ependymoma, pinealoma, hemangioblastoma, acoustic neuroma, oligodendroglioma, meningioma, melanoma, neuroblastoma, retinoblastoma, leukemia, lymphoma, or Kaposi sarcoma.

Examples of proliferative disorders include hematopoietic neoplastic disorders. As used herein, the term "hematopoietic neoplastic disorders" includes diseases involving hyperplastic/neoplastic cells of hematopoietic origin, e.g., arising from myeloid, lymphoid or erythroid lineages, or precursor cells thereof. The diseases can arise from poorly differentiated acute leukemias, e.g., erythroblastic leukemia and acute megakaryoblastic leukemia. Additional exemplary myeloid disorders include, but are not limited to, acute promyeloid leukemia (APML), acute myelogenous leukemia (AML) and chronic myelogenous leukemia (CML) (reviewed in Vaickus (1991), Crit Rev. Oncol./Hemotol. 11:267-97); lymphoid malignancies include, but are not limited to acute lymphoblastic leukemia (ALL) which includes B-lineage ALL and T-lineage ALL, chronic lymphocytic leukemia (CLL), prolymphocytic leukemia (PLL), hairy cell leukemia (HLL) and Waldenstrom's macroglobulinemia (WM). Additional forms of malignant lymphomas include, but are not limited to non-Hodgkin lymphoma and variants thereof, peripheral T cell lymphomas, adult T cell leukemia/lymphoma (ATL), cutaneous T-cell lymphoma (CTCL), large granular lymphocytic leukemia (LGF), Hodgkin's disease and Reed-Sternberg disease.

Examples of cellular proliferative and/or differentiative disorders of the breast include, but are not limited to, proliferative breast disease including, e.g., epithelial hyperplasia, sclerosing adenosis, and small duct papillomas; tumors, e.g., stromal tumors such as fibroadenoma, phyllodes tumor, and sarcomas, and epithelial tumors such as large duct papilloma; carcinoma of the breast including in situ (noninvasive) carcinoma that includes ductal carcinoma in situ (including Paget's disease) and lobular carcinoma in situ, and invasive (infiltrating) carcinoma including, but not limited to, invasive ductal carcinoma, invasive lobular carcinoma, medullary carcinoma, colloid (mucinous) carcinoma, tubular carcinoma, and invasive papillary carcinoma, and miscellaneous malignant neoplasms. Disorders in the male breast include, but are not limited to, gynecomastia and carcinoma.

Examples of cellular proliferative and/or differentiative disorders of the skin include, but are not limited to proliferative skin disease such as melanomas, including mucosal melanoma, superficial spreading melanoma, nodular melanoma, lentigo (e.g. lentigo maligna, lentigo maligna melanoma, or acral lentiginous melanoma), amelanotic melanoma, desmoplastic melanoma, melanoma with features of a Spitz nevus, melanoma with small nevus-like cells, polypoid melanoma, and soft-tissue melanoma; basal cell carcinomas including micronodular basal cell carcinoma, superficial basal cell carcinoma, nodular basal cell carcinoma (rodent ulcer), cystic basal cell carcinoma, cicatricial basal cell carcinoma, pigmented basal cell carcinoma, aberrant basal cell carcinoma, infiltrative basal cell carcinoma, nevoid basal cell carcinoma syndrome, polypoid basal cell carcinoma, pore-like basal cell carcinoma, and fibroepithelioma of Pinkus; squamus cell carcinomas including acanthoma (large cell acanthoma), adenoid squamous cell carcinoma, basaloid squamous cell carcinoma, clear cell squamous cell carcinoma, signet-ring cell squamous cell carcinoma, spindle cell squamous cell carcinoma, Marjolin's ulcer, erythroplasia of Queyrat, and Bowen's disease; or other skin or subcutaneous tumors.

Examples of cellular proliferative and/or differentiative disorders of the lung include, but are not limited to, bronchogenic carcinoma, including paraneoplastic syndromes, bronchioloalveolar carcinoma, neuroendocrine tumors, such as bronchial carcinoid, miscellaneous tumors, and metastatic tumors; pathologies of the pleura, including inflammatory pleural effusions, noninflammatory pleural effusions, pneumothorax, and pleural tumors, including solitary fibrous tumors (pleural fibroma) and malignant mesothelioma.

Examples of cellular proliferative and/or differentiative disorders of the colon include, but are not limited to, non-neoplastic polyps, adenomas, familial syndromes, colorectal carcinogenesis, colorectal carcinoma, and carcinoid tumors.

Examples of cellular proliferative and/or differentiative disorders of the liver include, but are not limited to, nodular hyperplasias, adenomas, and malignant tumors, including primary carcinoma of the liver and metastatic tumors.

Examples of cellular proliferative and/or differentiative disorders of the ovary include, but are not limited to, ovarian tumors such as, tumors of coelomic epithelium, serous tumors, mucinous tumors, endometrioid tumors, clear cell adenocarcinoma, cystadenofibroma, Brenner tumor, surface epithelial tumors; germ cell tumors such as mature (benign) teratomas, monodermal teratomas, immature malignant teratomas, dysgerminoma, endodermal sinus tumor, choriocarcinoma; sex cord-stomal tumors such as, granulosa-theca cell tumors, thecomafibromas, androblastomas, hill cell tumors, and gonadoblastoma; and metastatic tumors such as Krukenberg tumors.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments described herein can be employed in practicing the invention. It is intended that the following claims define the scope and that methods and structures within the scope of these claims and their equivalents be covered thereby.

EXAMPLES

Example 1

Synthesis of 6-chlorotryptophan Fmoc amino acids

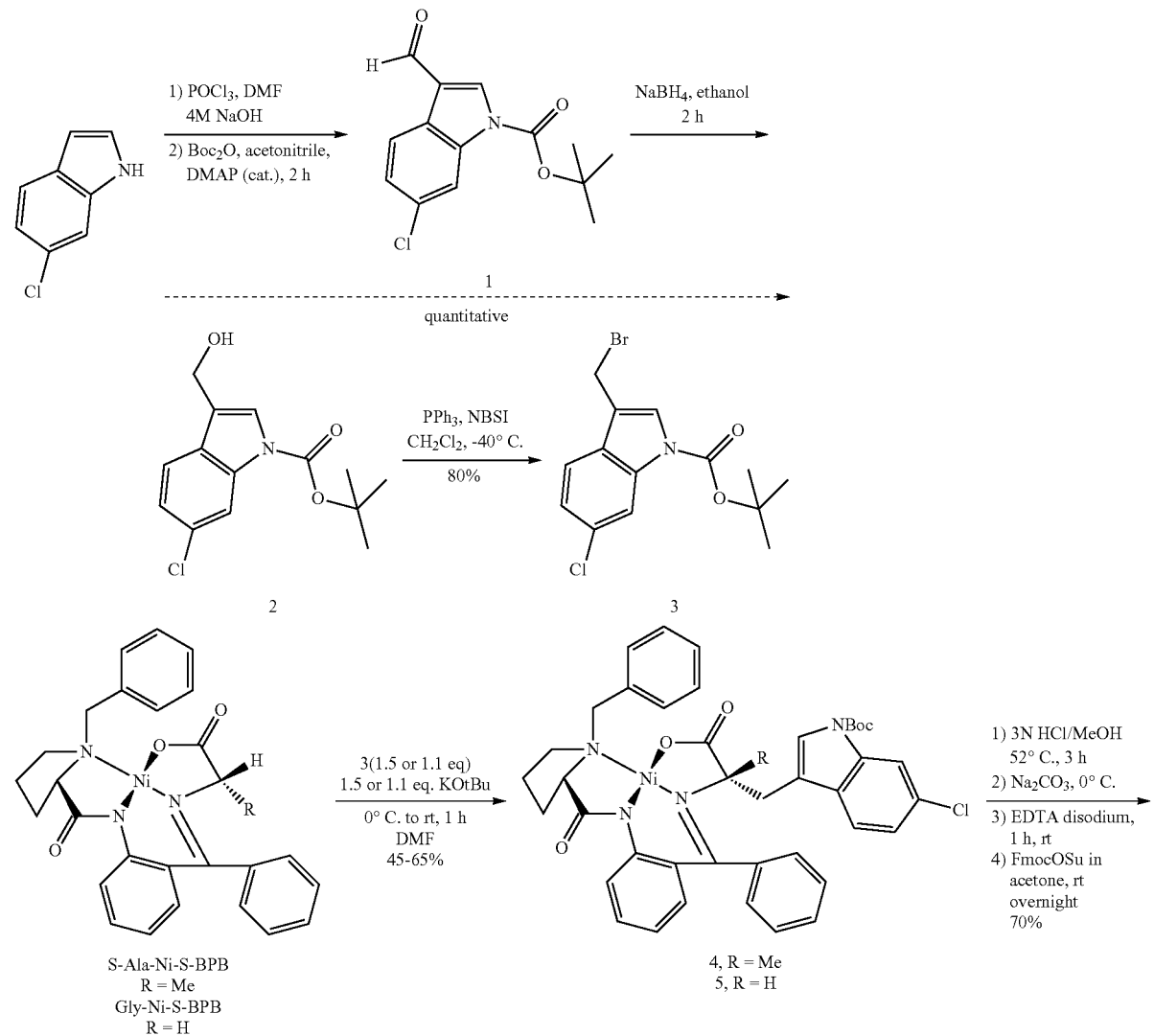

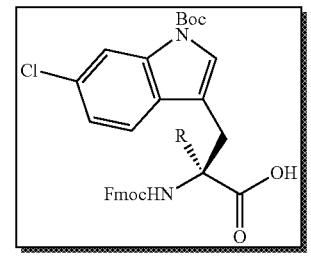

6, R = Me
7, R = H

Tert-butyl 6-chloro-3-formyl-1H-indole-1-carboxylate, 1. To a stirred solution of dry DMF (12 mL) was added dropwise POCl₃ (3.92 mL, 43 mmol, 1.3 equiv) at 0° C. under Argon. The solution was stirred at the same temperature for 20 min before a solution of 6-chloroindole (5.0 g, 33 mmol, 1 eq.) in dry DMF (30 mL) was added dropwise. The resulting mixture was allowed to warm to room temperature and stirred for an additional 2.5 h. Water (50 mL) was added and the solution was neutralized with 4M aqueous NaOH (pH~8). The resulting solid was filtered off, washed with water and dried under vacuum. This material was directly used in the next step without additional purification. To a stirred solution of the crude formyl indole (33 mmol, 1 eq.) in THF (150 mL) was added successively Boc₂O (7.91 g, 36.3 mmol, 1.1 equiv) and DMAP (0.4 g, 3.3 mmol, 0.1 equiv) at room temperature under N₂. The resulting mixture was stirred at room temperature for 1.5 h and the solvent was evaporated under reduced pressure. The residue was taken up in EtOAc and washed with 1N HCl, dried and concentrated to give the formyl indole 1 (9 g, 98% over 2 steps) as a white solid. ¹H NMR (CDCl₃) δ: 1.70 (s, Boc, 9H); 7.35 (dd, 1H); 8.21 (m, 3H); 10.07 (s, 1H).

Tert-butyl 6-chloro-3-(hydroxymethyl)-1H-indole-1-carboxylate, 2. To a solution of compound 1 (8.86 g, 32 mmol, 1 eq.) in ethanol (150 mL) was added NaBH₄ (2.4 g, 63 mmol, 2 eq.). The reaction was stirred for 3 h at room temperature. The reaction mixture was concentrated and the residue was poured into diethyl ether and water. The organic layer was separated, dried over magnesium sulfate and concentrated to give a white solid (8.7 g, 98%). This material was directly used in the next step without additional purification. ¹H NMR (CDCl₃) δ: 1.65 (s, Boc, 9H); 4.80 (s, 2H, CH₂); 7.21 (dd, 1H); 7.53 (m, 2H); 8.16 (bs, 1H).

Tert-butyl 3-(bromomethyl)-6-chloro-1H-indole-1-carboxylate, 3. To a solution of compound 2 (4.1 g, 14.6 mmol, 1 eq.) in dichloromethane (50 mL) under argon was added a solution of triphenylphosphine (4.59 g, 17.5 mmol, 1.2 eq.) in dichloromethane (50 mL) at −40° C. The reaction solution was stirred an additional 30 min at 40° C. Then NBS (3.38 g, 19 mmol, 1.3 eq.) was added. The resulting mixture was allowed to warm to room temperature and stirred overnight. Dichloromethane was evaporated, Carbon Tetrachloride (100 mL) was added and the mixture was stirred for 1 h and filtrated. The filtrate was concentrated, loaded in a silica plug and quickly eluted with 25% EtOAc in Hexanes. The solution was concentrated to give a white foam (3.84 g, 77%). ¹H NMR (CDCl₃) δ: 1.66 (s, Boc, 9H); 4.63 (s, 2H, CH₂); 7.28 (dd, 1H); 7.57 (d, 1H); 7.64 (bs, 1H); 8.18 (bs, 1H).

αMe-6Cl-Trp(Boc)-Ni-S-BPB, 4. To S-Ala-Ni-S-BPB (2.66 g, 5.2 mmol, 1 eq.) and KO-tBu (0.87 g, 7.8 mmol, 1.5 eq.) was added 50 mL of DMF under argon. The bromide derivative compound 3 (2.68 g, 7.8 mmol, 1.5 eq.) in solution of DMF (5.0 mL) was added via syringe. The reaction mixture was stirred at ambient temperature for 1 h. The solution was then quenched with 5% aqueous acetic acid and diluted with water. The desired product was extracted in dichloromethane, dried and concentrated. The oily product 4 was purified by flash chromatography (solid loading) on normal phase using EtOAc and Hexanes as eluents to give a red solid (1.78 g, 45% yield). αMe-6Cl-Trp(Boc)-Ni-S-BPB, 4: M+H calc. 775.21, M+H obs. 775.26; ¹H NMR (CDCl₃) δ: 1.23 (s, 3H, αMe); 1.56 (m, 11H, Boc+CH₂); 1.82-2.20 (m, 4H, 2CH₂); 3.03 (m, 1H, CHα); 3.24 (m, 2H, CH₂); 3.57 and 4.29 (AB system, 2H, CH₂ (benzyl), J=12.8 Hz); 6.62 (d, 2H); 6.98 (d, 1H); 7.14 (m, 2H); 7.23 (m, 1H); 7.32-7.36 (m, 5H); 7.50 (m, 2H); 7.67 (bs, 1H); 7.98 (d, 2H); 8.27 (m, 2H).

Fmoc-αMe-6Cl-Trp(Boc)-OH, 6. To a solution of 3N HCl/MeOH (1/3, 15 mL) at 50° C. was added a solution of compound 4 (1.75 g, 2.3 mmol, 1 eq.) in MeOH (5 ml) dropwise. The starting material disappeared within 3-4 h. The acidic solution was then cooled to 0° C. with an ice bath and quenched with an aqueous solution of Na₂CO₃ (1.21 g, 11.5 mmol, 5 eq.). Methanol was removed and 8 more equivalents of Na₂CO₃ (1.95 g, 18.4 mmol) were added to the suspension. The Nickel scavenging EDTA disodium salt dihydrate (1.68 g, 4.5 mmol, 2 eq.) was then added and the suspension was stirred for 2 h. A solution of Fmoc-OSu (0.84 g, 2.5 mmol, 1.1 eq.) in acetone (50 mL) was added and the reaction was stirred overnight. Afterwards, the reaction was diluted with diethyl ether and 1N HCl. The organic layer was then dried over magnesium sulfate and concentrated in vacuo. The desired product 6 was purified on normal phase using acetone and dichloromethane as eluents to give a white foam (0.9 g, 70% yield). Fmoc-αMe-6Cl-Trp(Boc)-OH, 6: M+H calc. 575.19, M+H obs. 575.37; ¹H NMR (CDCl₃) 1.59 (s, 9H, Boc); 1.68 (s, 3H, Me); 3.48 (bs, 2H, CH₂); 4.22 (m, 1H, CH); 4.39 (bs, 2H, CH₂); 5.47 (s, 1H, NH); 7.10 (m, 1H); 7.18 (m, 2H); 7.27 (m, 2H); 7.39 (m, 2H); 7.50 (m, 2H); 7.75 (d, 2H); 8.12 (bs, 1H).

6Cl-Trp(Boc)-Ni-S-BPB, 5. To Gly-Ni-S-BPB (4.6 g, 9.2 mmol, 1 eq.) and KO-tBu (1.14 g, 10.1 mmol, 1.1 eq.) was added 95 mL of DMF under argon. The bromide derivative compound 3 (3.5 g, 4.6 mmol, 1.1 eq.) in solution of DMF (10 mL) was added via syringe. The reaction mixture was stirred at ambient temperature for 1 h. The solution was then quenched with 5% aqueous acetic acid and diluted with water. The desired product was extracted in dichloromethane, dried and concentrated. The oily product 5 was purified by flash chromatography (solid loading) on normal phase using EtOAc and Hexanes as eluents to give a red solid (5 g, 71% yield). 6Cl-Trp(Boc)-Ni-S-BPB, 5: M+H calc. 761.20, M+H obs. 761.34; ¹H NMR (CDCl₃) δ: 1.58 (m, 11H, Boc+CH₂); 1.84 (m, 1H); 1.96 (m, 1H); 2.24 (m, 2H, CH₂); 3.00 (m, 1H, CH$_\alpha$); 3.22 (m, 2H, CH$_2$); 3.45 and 4.25 (AB system, 2H, CH$_2$ (benzyl), J=12.8 Hz); 4.27 (m, 1H, CH$_\alpha$); 6.65 (d, 2H); 6.88 (d, 1H); 7.07 (m, 2H); 7.14 (m, 2H); 7.28 (m, 3H); 7.35-7.39 (m, 2H); 7.52 (m, 2H); 7.96 (d, 2H); 8.28 (m, 2H).

Fmoc-6Cl-Trp(Boc)-OH, 7. To a solution of 3N HCl/MeOH (1/3, 44 mL) at 50° C. was added a solution of compound 5 (5 g, 6.6 mmol, 1 eq.) in MeOH (10 ml) dropwise. The starting material disappeared within 3-4 h. The acidic solution was then cooled to 0° C. with an ice bath and quenched with an aqueous solution of Na$_2$CO$_3$ (3.48 g, 33 mmol, 5 eq.). Methanol was removed and 8 more equivalents of Na$_2$CO$_3$ (5.57 g, 52 mmol) were added to the suspension. The Nickel scavenging EDTA disodium salt dihydrate (4.89 g, 13.1 mmol, 2 eq.) and the suspension was stirred for 2 h. A solution of Fmoc-OSu (2.21 g, 6.55 mmol, 1.1 eq.) in acetone (100 mL) was added and the reaction was stirred overnight. Afterwards, the reaction was diluted with diethyl ether and 1N HCl. The organic layer was then dried over magnesium sulfate and concentrated in vacuo. The desired product 7 was purified on normal phase using acetone and dichloromethane as eluents to give a white foam (2.6 g, 69% yield). Fmoc-6Cl-Trp(Boc)-OH, 7: M+H calc. 561.17, M+H obs. 561.37; $^1$H NMR (CDCl$_3$) 1.63 (s, 9H, Boc); 3.26 (m, 2H, CH$_2$); 4.19 (m, 1H, CH); 4.39 (m, 2H, CH$_2$); 4.76 (m, 1H); 5.35 (d, 1H, NH); 7.18 (m, 2H); 7.28 (m, 2H); 7.39 (m, 3H); 7.50 (m, 2H); 7.75 (d, 2H); 8.14 (bs, 1H).

Example 1a

Synthesis of Alkyne Compounds for Use in Synthesis of Compounds of Formula I

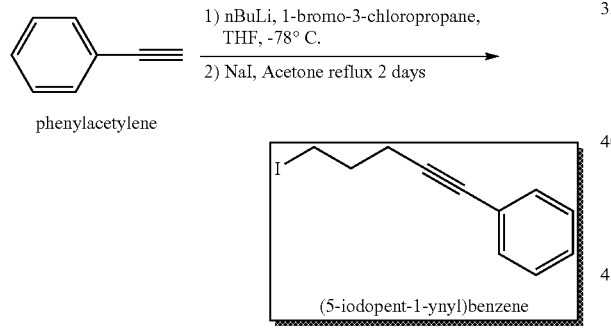

Synthesis of (5-iodopent-1-ynyl)benzene

To a solution of THF (200 mL) into reaction flask was added (5-chloropent-1-ynyl)benzene Phenylacetylene (10 g, 97.91 mmol). Then the reaction mixture was cooled to −78° C. in a dry ice bath. nBuLi (95.95 mmol, 38.39 mL) was added dropwise and allowed to react for 0.5 h at −78° C. At −78° C., 1-bromo-3-chloropropane was added. Stirred for 5 hours during which the reaction was allowed to warm up to room temperature. Then reaction was refluxed at 90° C. for 3 hours. The solvent was distilled off, then water (150 mL) and ether (150 mL) was added. The crude product was extracted, ether was distilled off and the resulting crude mixture was dissolved in acetone. Sodium iodide (22.92 mmol, 3.44 g) was added into the solution. The reaction mixture, with reflux condenser attached, was heated to 70° C. for two days. Acetone was distilled off using short path distillation apparatus. Ether (150 mL) and water (150 mL) was added and carried out extraction. Ether was then dried over magnesium sulfate and distilled off resulting in 5.00 g of product (yield 98%). No further purification was carried out. $^1$H NMR (500 MHz, CDCl$_3$) 2.072 (m, 2H, CH$_2$); 2.605 (t, 2H, CH$_2$); 3.697 (m, 2H, CH$_2$); 7.276 (m, 2H, Phenyl); 7.389 (m, 2H, phenyl); 7.484 (m, 1H, phenyl).

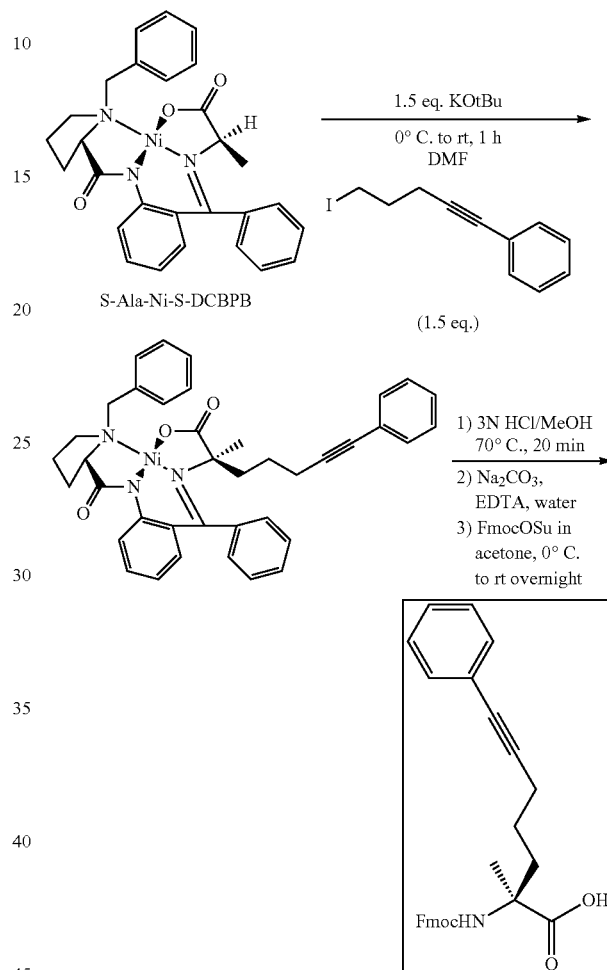

Synthesis of MeS5-PhenylAlkyne-Ni-S-BPB

To S-Ala-Ni-SBPB (18.17 mmol, 9.30 g) and KO-tBu (27.26 mmol, 3.05 g) was added 200 mL of DMF under argon. (5-iodopent-1-ynyl)benzene (27.26 mmol, 7.36 g) in solution of DMF (50 mL) was added via syringe. The reaction mixture was stirred at ambient temperature for 1 h. The solution was then quenched with acetic acid (27.26 mmol, 1.58 mL) and diluted with water (100 mL). The product was extracted with dichloromethane (100 mL), separated and dried over magnesium sulfate. The crude product was purified by flash chromatography on normal phase using acetone and dichloromethane as eluents to afford the desired product as a red solid (9.48 g, 79.8%). M+H calc. 654.22, M+H obs. 654.4; $^1$H NMR (500 MHz, CDCl$_3$) 1.17 (s, 3H, Me (Me-Phe)); 1.57 (m, 1H, CH$_2$); 1.67 (m, 1H, CH$_2$); 1.89 (m, 1H, CH$_2$); 2.06 (m, 1H, CH$_2$); 2.24 (m, 2H, CH$_2$); 3.05 (m, 1H); 3.18 (s, 2H); 3.26 (m, 1H); 3.56 and 4.31 (AB system, 2H, CH$_2$ (benzyl), J=12.8 Hz); 6.64 (m, 2H); 6.94 (d, 1H); 7.12 (m, 1H); 7.20 (m, 1H); 7.20-7.40 (m, 10H); 7.43 (m, 2H); 8.01 (d, 2H); 8.13 (m, 1H).

Synthesis of (S)-2-(((9H-fluoren-9-yl)methoxy)carbonylamino)-2-methyl-7-phenylhept-6-ynoic acid To a solution of 3N HCl/MeOH (1/1, 23 mL) at 70° C. was added a solution of MeS5-PhenylAlkyne-Ni-S-BPB (14.5 mmol, 9.48 g) in MeOH (70 ml) dropwise. The starting material disappeared within 10-20 min. The green reaction mixture was then concentrated in vacuo. Water was added (100 mL) and the resulting precipitate (S-BPB HCl salt) was filtered off. Sodium carbonate (116 mmol, 12.29 g) and EDTA (29 mmol, 10.79 g) were added to the mother liquor. The mixture was stirred at room temperature for 3 hours to scavenge the free nickel. After addition of 50 mL of acetone, the reaction was cooled to 0° C. with an ice bath. Fmoc-OSu (16.68 mmol, 5.62 g) dissolved in acetone (50 ml) was added and the reaction was allowed to warm up to ambient temperature with stirring overnight. Afterwards, the reaction was diluted with ethyl acetate (300 mL). Then the organic layer was separated. The aqueous layer was acidified with conc. HCl. The desired product was extracted with dichloromethane (400 mL), dried over magnesium sulfate and concentrated in vacuo. The crude product was purified by flash chromatography on normal phase using 10% MBTE/DCM as eluents to afford the desired product as a white solid (6.05 g, 51%). M+H calc. 454.53, M+H obs. 454.2; $^1$H NMR (CDCl$_3$) □1.50 (bs, 2H, CH$_2$); 1.60 (bs, 3H, CH$_3$); 2.05 (bs, 1H, CH$_2$); 2.30 (bs, 1H, CH$_2$); 2.42 (bs, 2H, CH$_2$); 4.20 (m, 1H, CH); 4.40 (bs, 2H, CH$_2$); 5.58 (s, 1H, NH); 7.26 (m, 3H); 7.32 (m, 2H); 7.37 (m, 4H); 7.58 (d, 2H); 7.76 (d, 2H).

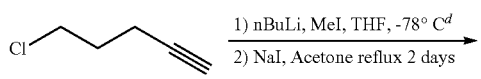

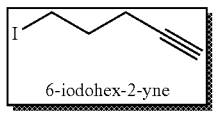

6-iodohex-2-yne

Synthesis of 6-iodohex-2-yne

To a solution of THF (250 mL) into reaction flask was added 5-chloro-1-pentyne (48.7 mmol, 5.0 g). Then the reaction mixture was cooled to −78° C. in a dry ice bath. nBuLi (51.1 mmol, 20.44 mL) was added dropwise and allowed to react for 0.5 h at −78° C. and allowed to warm to room temperature. Then methyl iodide (54.5 mmol, 3.39 mL) was added to the reaction mixture. The reaction was stirred for 5 hours. Water was added (1.5 mL) and the THF was distilled off. The crude product was extracted with pentane (100 mL) and water (100 mL). Pentane was distilled off and the resulting crude mixture was dissolved in acetone (300 mL). Sodium iodide (172.9 mmol, 25.92 g) was added into the solution. The reaction mixture, with reflux condenser attached, was heated to 70° C. for two days. Acetone was distilled off using short path distillation apparatus. Ether (100 mL) and water (100 mL) was added and carried out extraction. Ether was then dried over magnesium sulfate and distilled off resulting in 8.35 g of product (yield 83%). No further purification was carried out. $^1$H NMR (500 MHz, CDCl$_3$) δ 1.762 (t, 3H, CH$_3$); 1.941 (m, 2H, CH$_2$); 2.245 (m, 2H, CH$_2$); 3.286 (m, 2H, CH$_2$).

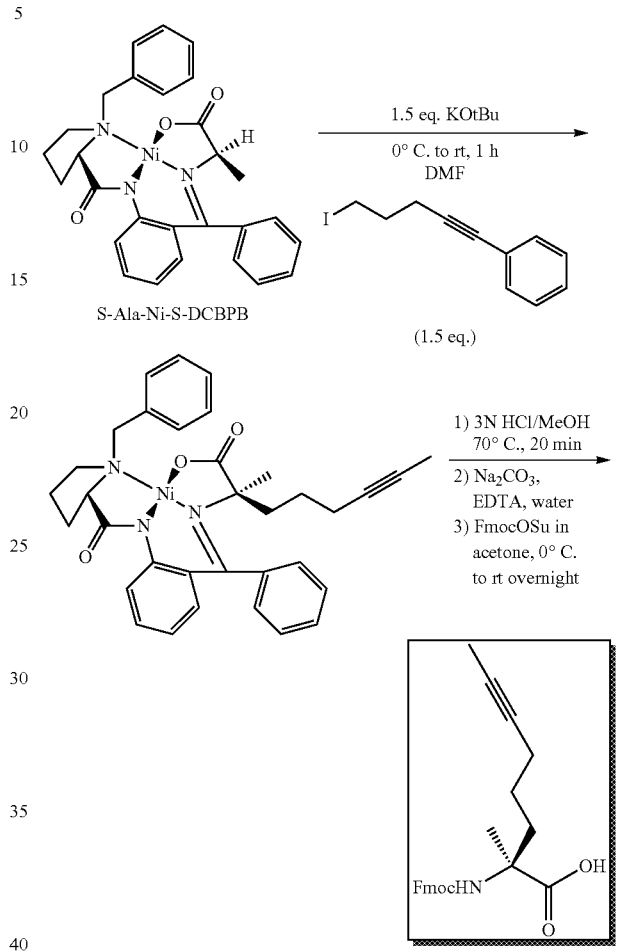

Synthesis of MeS5-MethylAlkyne-Ni-S-BPB

To S-Ala-Ni-SBPB (19.53 mmol, 10 g) and KO-tBu (29.29 mmol, 3.28 g) was added 200 mL of DMF under argon. 6-iodohex-2-yne (29.29 mmol, 6.09 g) in solution of DMF (50 mL) was added via syringe. The reaction mixture was stirred at ambient temperature for 1 h. The solution was then quenched with acetic acid (29.29 mmol, 1.69 mL) and diluted with water (100 mL). The product was extracted with dichloromethane (300 mL), separated and dried over magnesium sulfate. The crude product was purified by flash chromatography on normal phase using acetone and dichloromethane as eluents to afford the desired product as a red solid (8.10 g, 70%). M+H calc. 592.2, M+H obs. 592.4; $^1$H NMR (500 Mz, CDCl$_3$) δ 1.17 (s, 3H, CH$_3$ (αMe-Phe)); 1.57 (m, 1H, CH$_2$); 1.67 (m, 1H, CH$_2$); 1.89 (m, 1H, CH$_2$); 2.06 (m, 1H, CH$_2$); 2.24 (m, 2H, CH$_2$); 3.05 (m, 1H); 3.18 (s, 2H); 3.26 (m, 1H); 3.56 and 4.31 (AB system, 2H, CH$_2$ (benzyl), J=12.8 Hz); 6.64 (m, 2H); 6.94 (d, 1H); 7.12 (m, 1H); 7.20 (m, 1H); 7.20-7.40 (m, 10H); 7.43 (m, 2H); 8.01 (d, 2H); 8.13 (m, 1H).

Synthesis of (S)-2-(((9H-fluoren-9-yl)methoxy)carbonylamino)-2-methyloct-6-ynoic acid To a solution of 3N HCl/MeOH (1/1, 23 mL) at 70° C. was added a solution of MeS5-MethylAlkyne-Ni-S-BPB (13.70 mmol, 8.10 g)) in methanol (70 ml) dropwise. The starting material disappeared within 10-20 min. The green reaction mixture was then concentrated in vacuo. Water (150 mL) was added and the resulting precipitate (S-BPB HCl salt) was filtered off. Sodium carbonate (116 mmol, 12.29 g) EDTA (29 mmol, 10.79 g) were added to the mother liquor. The mixture was stirred at room temperature for 3 hours to scavenge the free nickel. After addition of 75 mL of acetone, the reaction was cooled to 0° C. with an ice bath. Fmoc-OSu (15.76 mmol, 5.31 g) dissolved in acetone (75 ml) was added and the reaction was allowed to warm up to ambient temperature with stirring overnight. Afterwards, the reaction was diluted with ethyl acetate (200 mL). Then the organic layer was separated. The aqueous layer was acidified with conc. HCl. The desired product was extracted with dichloromethane (200 mL), dried over magnesium sulfate and concentrated in vacuo. The crude product was purified by flash chromatography on normal phase using 10% MBTE/DCM as eluents to afford the desired product as a white solid (2.40 g, 45%). M+H calc. 392.18, M+H obs. 392.3; $^1$H NMR (500 Mz, CDCl$_3$) δ 1.38 (bs, 1H, CH$_2$); 1.50 (bs, 1H, CH$_2$); 1.60 (bs, 2H, CH$_2$); 1.75 (s, 3H, CH$_3$); 1.95 (bs, 2H, CH$_2$); 2.10 (bs, 3H, CH$_3$); 4.20 (m, 1H, CH); 4.40 (bs, 2H, CH$_2$); 5.58 (s, 1H, NH); 7.32 (m, 2H); 7.42 (m, 2H); 7.59 (d, 2H); 7.78 (d, 2H).

Example 2

Peptidomimetic Macrocycles of Formula I

Peptidomimetic macrocycles are prepared as described herein and as in pending U.S. patent application Ser. No. 12/037,041, filed Feb. 25, 2008, which is hereby incorporated by reference in its entirety. Peptidomimetic macrocycles are designed by replacing two or more naturally occurring amino acids with the corresponding synthetic amino acids. Substitutions are made at i and i+4, and i and i+7 positions. Peptide synthesis is performed either manually or on an automated peptide synthesizer (Applied Biosystems, model 433A), using solid phase conditions, rink amide AM resin (Novabiochem), and Fmoc main-chain protecting group chemistry. For the coupling of natural Fmoc-protected amino acids (Novabiochem), 10 equivalents of amino acid and a 1:1:2 molar ratio of coupling reagents HBTU/HOBt (Novabiochem)/DIEA are employed. Non-natural amino acids (4 equiv) are coupled with a 1:1:2 molar ratio of HATU (Applied Biosystems)/HOBt/DIEA. The N-termini of the synthetic peptides are acetylated, while the C-termini are amidated.

Generally, ully protected resin-bound peptides were synthesized on a PEG-PS resin (loading 0.45 mmol/g) on a 0.5 mmol scale. Deprotection of the temporary Fmoc group was achieved by 3×10 min treatments of the resin bound peptide with 20% (v/v) piperidine in DMF. After washing with NMP (3×), dichloromethane (3×) and NMP (3×), coupling of each successive amino acid was achieved with 1×60 min incubation with the appropriate preactivated Fmoc-amino acid derivative. All protected amino acids (1.0 mmol) were dissolved in NMP and activated with HCTU (1.0 mmol), Cl-HOBt (1.0 mmol) and DIEA (2.0 mmol) prior to transfer of the coupling solution to the deprotected resin-bound peptide. After coupling was completed, the resin was washed in preparation for the next deprotection/coupling cycle. Acetylation of the amino terminus was carried out in the presence of acetic anhydride/DIEA in NMP. The LC-MS analysis of a cleaved and deprotected sample obtained from an aliquot of the fully assembled resin-bound peptide was accomplished in order to verifying the completion of each coupling.

In a typical example for the preparation of a peptidomimetic macrocycle comprising a 1,4-triazole group (e.g. SP153), 20% (v/v) 2,6-lutidine in DMF was added to the peptide resin (0.5 mmol) in a 40 ml glass vial and shaken for 10 minutes. Sodium ascorbate (0.25 g, 1.25 mmol) and diisopropylethylamine (0.22 ml, 1.25 mmol) were then added, followed by copper(I) iodide (0.24 g, 1.25 mmol) and the resulting reaction mixture was mechanically shaken 16 hours at ambient temperature.

In a typical example for the preparation of a peptidomimetic macrocycle comprising a 1,5-triazole group (SP932, SP933), a peptide resin (0.25 mmol) was washed with anhydrous DCM. Resin was loaded into a microwave vial. Vessel was evacuated and purged with nitrogen. Chloro(pentamethylcyclopentadienyl)bis(triphenylphosphine)ruthenium(II), 10% loading, (Strem 44-0117) was added. Anhydrous toluene was added to the reaction vessel. The reaction was then loaded into the microwave and held at 90° C. for 10 minutes. Reaction may need to be pushed a subsequent time for completion. In other cases, Chloro(1,5-cyclooctadiene)(pentamethylcyclopentadienyl)ruthenium ("Cp*RuCl(cod)") may be used, for example at room temperature in a solvent comprising toluene.

In a typical example for the preparation of a peptidomimetic macrocycle comprising an iodo-substituted triazole group (e.g. SP457), THF (2 ml) was added to the peptide resin (0.05 mmol) in a 40 ml glass vial and shaken for 10 minutes. N-bromosuccimide (0.04 g, 0.25 mmol), copper(I) iodide (0.05 g, 0.25 mmol) and diisopropylethylamine (0.04 ml, 0.25 mmol) were then added and the resulting reaction mixture was mechanically shaken 16 hours at ambient temperature. Iodo-triazole crosslinkers may be further substituted by a coupling reaction, for example with boronic acids, to result in a peptidomimetic macrocycle such as SP465. In a typical example, DMF (3 ml) was added to the iodo-triazole peptide resin (0.1 mmol) in a 40 ml glass vial and shaken for 10 minutes. Phenyl boronic acid (0.04 g, 0.3 mmol), tetrakis(triphenylphosphine)palladium(0) (0.006 g, 0.005 mmol) and potassium carbonate (0.083 g, 0.6 mmol) were then added and the resulting reaction mixture was mechanically shaken 16 hours at 70□C. Iodo-triazole crosslinkers may also be further substituted by a coupling reaction, for example with a terminal alkyne (e.g. Sonogashira coupling), to result in a peptidomimetic macrocycle such as SP468. In a typical example, 2:1 THF:triethylamine (3 ml) was added to the iodo-triazole peptide resin (0.1 mmol) in a 40 ml glass vial and shaken for 10 minutes. N-BOC-4-pentyne-1-amine (0.04 g, 0.2 mmol) and bis(triphenylphosphine)palladiumchloride (0.014 g, 0.02 mmol) were added and shaken for 5 minutes. Copper(I) iodide (0.004 g, 0.02 mmol) was then added and the resulting reaction mixture was mechanically shaken 16 hours at 70□C.

The triazole-cyclized resin-bound peptides were deprotected and cleaved from the solid support by treatment with TFA/H$_2$O/TIS (95/5/5 v/v) for 2.5 h at room temperature. After filtration of the resin the TFA solution was precipitated in cold diethyl ether and centrifuged to yield the desired product as a solid. The crude product was purified by preparative HPLC. For example, purification of cross-linked compounds is achieved by high performance liquid chromatography (HPLC) (Varian ProStar) on a reverse phase C18 column (Varian) to yield the pure compounds. Chemical composition of the pure products is confirmed by LC/MS mass spectrometry (Micromass LCT interfaced with Agilent 1100 HPLC system) and amino acid analysis (Applied Biosystems, model 420A).

Table 4 shows a list of peptidomimetic macrocycles of Formula I.

TABLE 4

| SP- | Sequence |
| --- | --- |
| 1 | Ac-F$4rn6AYWEAc3cL$4a5AAA-NH2 |
| 2 | Ac-F$4rn6AYWEAc3cL$4a5AAibA-NH2 |
| 3 | Ac-LTF$4rn6AYWAQL$4a5SANle-NH2 |
| 4 | Ac-LTF$4rn6AYWAQL$4a5SAL-NH2 |
| 5 | Ac-LTF$4rn6AYWAQL$4a5SAM-NH2 |
| 6 | Ac-LTF$4rn6AYWAQL$4a5SAhL-NH2 |
| 7 | Ac-LTF$4rn6AYWAQL$4a5SAF-NH2 |
| 8 | Ac-LTF$4rn6AYWAQL$4a5SAI-NH2 |
| 9 | Ac-LTF$4rn6AYWAQL$4a5SAChg-NH2 |
| 10 | Ac-LTF$4rn6AYWAQL$4a5SAAib-NH2 |
| 11 | Ac-LTF$4rn6AYWAQL$4a5SAA-NH2 |
| 12 | Ac-LTF$4rn6AYWA$4a5L$S$Nle-NH2 |
| 13 | Ac-LTF$4rn6AYWA$4a5L$S$A-NH2 |
| 14 | Ac-F$4rn6AYWEAc3cL$4a5AANle-NH2 |
| 15 | Ac-F$4rn6AYWEAc3cL$4a5AAL-NH2 |
| 16 | Ac-F$4rn6AYWEAc3cL$4a5AAM-NH2 |
| 17 | Ac-F$4rn6AYWEAc3cL$4a5AAhL-NH2 |
| 18 | Ac-F$4rn6AYWEAc3cL$4a5AAF-NH2 |
| 19 | Ac-F$4rn6AYWEAc3cL$4a5AAI-NH2 |
| 20 | Ac-F$4rn6AYWEAc3cL$4a5AAChg-NH2 |
| 21 | Ac-F$4rn6AYWEAc3cL$4a5AACha-NH2 |
| 22 | Ac-F$4rn6AYWEAc3cL$4a5AAAib-NH2 |
| 23 | Ac-LTF$4rn6AYWAQL$4a5AAAibV-NH2 |
| 24 | Ac-LTF$4rn6AYWAQL$4a5AAAibV-NH2 |
| 25 | Ac-LTF$4rn6AYWAQL$4a5SAibAA-NH2 |
| 26 | Ac-LTF$4rn6AYWAQL$4a5SAibAA-NH2 |
| 27 | Ac-HLTF$4rn6HHWHQL$4a5AANleNle-NH2 |
| 28 | Ac-DLTF$4rn6HHWHQL$4a5RRLV-NH2 |
| 29 | Ac-HHTF$4rn6HHWHQL$4a5AAML-NH2 |
| 30 | Ac-F$4rn6HHWHQL$4a5RRDCha-NH2 |
| 31 | Ac-F$4rn6HHWHQL$4a5HRFV-NH2 |
| 32 | Ac-HLTF$4rn6HHWHQL$4a5AAhLA-NH2 |
| 33 | Ac-DLTF$4rn6HHWHQL$4a5RRChgl-NH2 |
| 34 | Ac-DLTF$4rn6HHWHQL$4a5RRChgl-NH2 |
| 35 | Ac-HHTF$4rn6HHWHQL$4a5AAChav-NH2 |
| 36 | Ac-F$4rn6HHWHQL$4a5RRDa-NH2 |
| 37 | Ac-F$4rn6HHWHQL$4a5HRAibG-NH2 |
| 38 | Ac-F$4rn6AYWAQL$4a5HHNleL-NH2 |
| 39 | Ac-F$4rn6AYWSAL$4a5HQANle-NH2 |
| 40 | Ac-F$4rn6AYWVQL$4a5QHChgl-NH2 |
| 41 | Ac-F$4rn6AYWTAL$4a5QQNlev-NH2 |
| 42 | Ac-F$4rn6AYWYQL$4a5HAibAa-NH2 |
| 43 | Ac-LTF$4rn6AYWAQL$4a5HHLa-NH2 |
| 44 | Ac-LTF$4rn6AYWAQL$4a5HHLa-NH2 |
| 45 | Ac-LTF$4rn6AYWAQL$4a5HQNlev-NH2 |
| 46 | Ac-LTF$4rn6AYWAQL$4a5HQNlev-NH2 |
| 47 | Ac-LTF$4rn6AYWAQL$4a5QQMl-NH2 |
| 48 | Ac-LTF$4rn6AYWAQL$4a5QQMl-NH2 |
| 49 | Ac-LTF$4rn6AYWAQL$4a5HAibhLV-NH2 |
| 50 | Ac-LTF$4rn6AYWAQL$4a5AHFA-NH2 |
| 51 | Ac-HLTF$4rn6HHWHQL$4a5AANlel-NH2 |
| 52 | Ac-DLTF$4rn6HHWHQL$4a5RRLa-NH2 |
| 53 | Ac-HHTF$4rn6HHWHQL$4a5AAMv-NH2 |
| 54 | Ac-F$4rn6HHWHQL$4a5RRDA-NH2 |
| 55 | Ac-F$4rn6HHWHQL$4a5HRFCha-NH2 |
| 56 | Ac-F$4rn6AYWEAL$4a5AA-NHAm |
| 57 | Ac-F$4rn6AYWEAL$4a5AA-NHiAm |
| 58 | Ac-F$4rn6AYWEAL$4a5AA-NHnPr3Ph |
| 59 | Ac-F$4rn6AYWEAL$4a5AA-NHnBu33Me |
| 60 | Ac-F$4rn6AYWEAL$4a5AA-NHnPr |
| 61 | Ac-F$4rn6AYWEAL$4a5AA-NHnEt2Ch |
| 62 | Ac-F$4rn6AYWEAL$4a5AA-NHnEt2Cp |
| 63 | Ac-F$4rn6AYWEAL$4a5AA-NHHex |
| 64 | Ac-LTF$4rn6AYWAQL$4a5AAIA-NH2 |
| 65 | Ac-LTF$4rn6AYWAQL$4a5AAIA-NH2 |
| 66 | Ac-LTF$4rn6AYWAAL$4a5AAMA-NH2 |
| 67 | Ac-LTF$4rn6AYWAAL$4a5AAMA-NH2 |
| 68 | Ac-LTF$4rn6AYWAQL$4a5AANleA-NH2 |
| 69 | Ac-LTF$4rn6AYWAQL$4a5AANleA-NH2 |
| 70 | Ac-LTF$4rn6AYWAQL$4a5AAIa-NH2 |
| 71 | Ac-LTF$4rn6AYWAQL$4a5AAIa-NH2 |
| 72 | Ac-LTF$4rn6AYWAAL$4a5AAMa-NH2 |
| 73 | Ac-LTF$4rn6AYWAAL$4a5AAMa-NH2 |
| 74 | Ac-LTF$4rn6AYWAQL$4a5AANlea-NH2 |
| 75 | Ac-LTF$4rn6AYWAQL$4a5AANlea-NH2 |
| 76 | Ac-LTF$4rn6AYWAAL$4a5AAIv-NH2 |
| 77 | Ac-LTF$4rn6AYWAAL$4a5AAIv-NH2 |
| 78 | Ac-LTF$4rn6AYWAQL$4a5AAMv-NH2 |
| 79 | Ac-LTF$4rn6AYWAAL$4a5AANlev-NH2 |
| 80 | Ac-LTF$4rn6AYWAAL$4a5AANlev-NH2 |
| 81 | Ac-LTF$4rn6AYWAQL$4a5AAIl-NH2 |
| 82 | Ac-LTF$4rn6AYWAQL$4a5AAIl-NH2 |
| 83 | Ac-LTF$4rn6AYWAAL$4a5AAMl-NH2 |
| 84 | Ac-LTF$4rn6AYWAQL$4a5AANlel-NH2 |
| 85 | Ac-LTF$4rn6AYWAQL$4a5AANlel-NH2 |
| 86 | Ac-F$4rn6AYWEAL$4a5AAMA-NH2 |
| 87 | Ac-F$4rn6AYWEAL$4a5AANleA-NH2 |
| 88 | Ac-F$4rn6AYWEAL$4a5AAIa-NH2 |
| 89 | Ac-F$4rn6AYWEAL$4a5AAMa-NH2 |
| 90 | Ac-F$4rn6AYWEAL$4a5AANlea-NH2 |
| 91 | Ac-F$4rn6AYWEAL$4a5AAIv-NH2 |
| 92 | Ac-F$4rn6AYWEAL$4a5AAMv-NH2 |
| 93 | Ac-F$4rn6AYWEAL$4a5AANlev-NH2 |
| 94 | Ac-F$4rn6AYWEAL$4a5AAIl-NH2 |
| 95 | Ac-F$4rn6AYWEAL$4a5AAMl-NH2 |
| 96 | Ac-F$4rn6AYWEAL$4a5AANlel-NH2 |
| 97 | Ac-F$4rn6AYWEAL$4a5AANlel-NH2 |
| 98 | Ac-LTF$4rn6AY6c1WAQL$4a5SAA-NH2 |
| 99 | Ac-LTF$4rn6AY6c1WAQL$4a5SAA-NH2 |
| 100 | Ac-WTF$4rn6FYWSQL$4a5AVAa-NH2 |
| 101 | Ac-WTF$4rn6FYWSQL$4a5AVAa-NH2 |
| 102 | Ac-WTF$4rn6VYWSQL$4a5AVA-NH2 |
| 103 | Ac-WTF$4rn6VYWSQL$4a5AVA-NH2 |
| 104 | Ac-WTF$4rn6FYWSQL$4a5SAAa-NH2 |
| 105 | Ac-WTF$4rn6VYWSQL$4a5SAAa-NH2 |
| 106 | Ac-WTF$4rn6VYWSQL$4a5AVAaa-NH2 |
| 107 | Ac-WTF$4rn6VYWSQL$4a5AVAaa-NH2 |
| 108 | Ac-LTF$4rn6AYWAQL$4a5AVG-NH2 |
| 109 | Ac-LTF$4rn6AYWAQL$4a5AVG-NH2 |
| 110 | Ac-LTF$4rn6AYWAQL$4a5AVQ-NH2 |
| 111 | Ac-LTF$4rn6AYWAQL$4a5AVQ-NH2 |
| 112 | Ac-LTF$4rn6AYWAQL$4a5SAa-NH2 |
| 113 | Ac-LTF$4rn6AYWAQL$4a5SAa-NH2 |
| 114 | Ac-LTF$4rn6AYWAQhL$4a5SAA-NH2 |
| 115 | Ac-LTF$4rn6AYWAQhL$4a5SAA-NH2 |
| 116 | Ac-LTF$4rn6AYWEQLStSA$4a5-NH2 |
| 117 | Ac-LTF$4rn6AYWAQL$4a5SLA-NH2 |
| 118 | Ac-LTF$4rn6AYWAQL$4a5SLA-NH2 |
| 119 | Ac-LTF$4rn6AYWAQL$4a5SWA-NH2 |
| 120 | Ac-LTF$4rn6AYWAQL$4a5SWA-NH2 |
| 121 | Ac-LTF$4rn6AYWAQL$4a5SVS-NH2 |
| 122 | Ac-LTF$4rn6AYWAQL$4a5SAS-NH2 |
| 123 | Ac-LTF$4rn6AYWAQL$4a5SVG-NH2 |
| 124 | Ac-ETF$4rn6VYWAQL$4a5SAa-NH2 |
| 125 | Ac-ETF$4rn6VYWAQL$4a5SAA-NH2 |
| 126 | Ac-ETF$4rn6VYWAQL$4a5SVA-NH2 |
| 127 | Ac-ETF$4rn6VYWAQL$4a5SLA-NH2 |
| 128 | Ac-ETF$4rn6VYWAQL$4a5SWA-NH2 |
| 129 | Ac-ETF$4rn6KYWAQL$4a5SWA-NH2 |
| 130 | Ac-ETF$4rn6VYWAQL$4a5SVS-NH2 |
| 131 | Ac-ETF$4rn6VYWAQL$4a5SAS-NH2 |
| 132 | Ac-ETF$4rn6VYWAQL$4a5SVG-NH2 |
| 133 | Ac-LTF$4rn6VYWAQL$4a5SSa-NH2 |
| 134 | Ac-ETF$4rn6VYWAQL$4a5SSa-NH2 |
| 135 | Ac-LTF$4rn6VYWAQL$4a5SNa-NH2 |
| 136 | Ac-ETF$4rn6VYWAQL$4a5SNa-NH2 |
| 137 | Ac-LTF$4rn6VYWAQL$4a5SAa-NH2 |
| 138 | Ac-LTF$4rn6VYWAQL$4a5SVA-NH2 |
| 139 | Ac-LTF$4rn6VYWAQL$4a5SVA-NH2 |
| 140 | Ac-LTF$4rn6VYWAQL$4a5SWA-NH2 |
| 141 | Ac-LTF$4rn6VYWAQL$4a5SVS-NH2 |
| 142 | Ac-LTF$4rn6VYWAQL$4a5SVS-NH2 |
| 143 | Ac-LTF$4rn6VYWAQL$4a5SAS-NH2 |
| 144 | Ac-LTF$4rn6VYWAQL$4a5SAS-NH2 |
| 145 | Ac-LTF$4rn6VYWAQL$4a5SVG-NH2 |
| 146 | Ac-LTF$4rn6VYWAQL$4a5SVG-NH2 |
| 147 | Ac-LTF$4rn6EYWAQCha$4a5SAA-NH2 |
| 148 | Ac-LTF$4rn6EYWAQCha$4a5SAA-NH2 |
| 149 | Ac-LTF$4rn6EYWAQCpg$4a5SAA-NH2 |
| 150 | Ac-LTF$4rn6EYWAQCpg$4a5SAA-NH2 |
| 151 | Ac-LTF$4rn6EYWAQF$4a5SAA-NH2 |
| 152 | Ac-LTF$4rn6EYWAQF$4a5SAA-NH2 |

TABLE 4-continued

| SP- | Sequence |
|---|---|
| 153 | Ac-LTF$4rn6EYWAQCba$4a5SAA-NH2 |
| 154 | Ac-LTF$4rn6EYWAQCba$4a5SAA-NH2 |
| 155 | Ac-LTF3Cl$4rn6EYWAQL$4a5SAA-NH2 |
| 156 | Ac-LTF3Cl$4rn6EYWAQL$4a5SAA-NH2 |
| 157 | Ac-LTF34F2$4rn6EYWAQL$4a5SAA-NH2 |
| 158 | Ac-LTF34F2$4rn6EYWAQCba$4a5SAA-NH2 |
| 159 | Ac-LTF34F2$4rn6EYWAQhL$4a5SAA-NH2 |
| 160 | Ac-LTF34F2$4rn6EYWAQhL$4a5SAA-NH2 |
| 161 | Ac-ETF$4rn6EYWAQL$4a5SAA-NH2 |
| 162 | Ac-LTF$4rn6AYWVQL$4a5SAA-NH2 |
| 163 | Ac-LTF$4rn6AHWAQL$4a5SAA-NH2 |
| 164 | Ac-LTF$4rn6AEWAQL$4a5SAA-NH2 |
| 165 | Ac-LTF$4rn6ASWAQL$4a5SAA-NH2 |
| 166 | Ac-LTF$4rn6AEWAQL$4a5SAA-NH2 |
| 167 | Ac-LTF$4rn6ASWAQL$4a5SAA-NH2 |
| 168 | Ac-LTF$4rn6AF4coohWAQL$4a5SAA-NH2 |
| 169 | Ac-LTF$4rn6AF4coohWAQL$4a5SAA-NH2 |
| 170 | Ac-LTF$4rn6AHWAQL$4a5AAIa-NH2 |
| 171 | Ac-LTF$4rn6FYWAQL$4a5AAIa-NH2 |
| 172 | Ac-ITF$4rn6EHWAQL$4a5AAIa-NH2 |
| 173 | Ac-ITF$4rn6EHWAQL$4a5AAIa-NH2 |
| 174 | Ac-ETF$4rn6EHWAQL$4a5AAIa-NH2 |
| 175 | Ac-ETF$4rn6EHWAQL$4a5AAIa-NH2 |
| 176 | Ac-LTF$4rn6AHWVQL$4a5AAIa-NH2 |
| 177 | Ac-ITF$4rn6FYWVQL$4a5AAIa-NH2 |
| 178 | Ac-LTF$4rn6EYWVQL$4a5AAIa-NH2 |
| 179 | Ac-ITF$4rn6EHWAQL$4a5AAIa-NH2 |
| 180 | Ac-LTF$4rn6AEWAQL$4a5AAIa-NH2 |
| 181 | Ac-LTF$4rn6AF4coohWAQL$4a5AAIa-NH2 |
| 182 | Ac-LTF$4rn6AF4coohWAQL$4a5AAIa-NH2 |
| 183 | Ac-LTF$4rn6AHWAQL$4a5AHFA-NH2 |
| 184 | Ac-ITF$4rn6FYWAQL$4a5AHFA-NH2 |
| 185 | Ac-ITF$4rn6FYWAQL$4a5AHFA-NH2 |
| 186 | Ac-ITF$4rn6FHWAQL$4a5AEFA-NH2 |
| 187 | Ac-ITF$4rn6FHWAQL$4a5AEFA-NH2 |
| 188 | Ac-ITF$4rn6EHWAQL$4a5AHFA-NH2 |
| 189 | Ac-ITF$4rn6EHWAQL$4a5AHFA-NH2 |
| 190 | Ac-LTF$4rn6AHWVQL$4a5AHFA-NH2 |
| 191 | Ac-ITF$4rn6FYWVQL$4a5AHFA-NH2 |
| 192 | Ac-LTF$4rn6EYWVQL$4a5AHFA-NH2 |
| 193 | Ac-ITF$4rn6EHWVQL$4a5AHFA-NH2 |
| 194 | Ac-ITF$4rn6EHWVQL$4a5AHFA-NH2 |
| 195 | Ac-ETF$4rn6EYWAAL$4a5SAA-NH2 |
| 196 | Ac-LTF$4rn6AYWVAL$4a5SAA-NH2 |
| 197 | Ac-LTF$4rn6AHWAAL$4a5SAA-NH2 |
| 198 | Ac-LTF$4rn6AEWAAL$4a5SAA-NH2 |
| 199 | Ac-LTF$4rn6AEWAAL$4a5SAA-NH2 |
| 200 | Ac-LTF$4rn6ASWAAL$4a5SAA-NH2 |
| 201 | Ac-LTF$4rn6ASWAAL$4a5SAA-NH2 |
| 202 | Ac-LTF$4rn6AYWAAL$4a5AAIa-NH2 |
| 203 | Ac-LTF$4rn6AYWAAL$4a5AAIa-NH2 |
| 204 | Ac-LTF$4rn6AYWAAL$4a5AHFA-NH2 |
| 205 | Ac-LTF$4rn6EHWAQL$4a5AHIa-NH2 |
| 206 | Ac-LTF$4rn6EHWAQL$4a5AHIa-NH2 |
| 207 | Ac-LTF$4rn6AHWAQL$4a5AHIa-NH2 |
| 208 | Ac-LTF$4rn6AYWAQL$4a5AAFa-NH2 |
| 209 | Ac-LTF$4rn6AYWAQL$4a5AAFa-NH2 |
| 210 | Ac-LTF$4rn6AYWAQL$4a5AAFa-NH2 |
| 211 | Ac-LTF$4rn6AYWAQL$4a5AAWa-NH2 |
| 212 | Ac-LTF$4rn6AYWAQL$4a5AAVa-NH2 |
| 213 | Ac-LTF$4rn6AYWAQL$4a5AAVa-NH2 |
| 214 | Ac-LTF$4rn6AYWAQL$4a5AALa-NH2 |
| 215 | Ac-LTF$4rn6AYWAQL$4a5AALa-NH2 |
| 216 | Ac-LTF$4rn6EYWAQL$4a5AAIa-NH2 |
| 217 | Ac-LTF$4rn6EYWAQL$4a5AAIa-NH2 |
| 218 | Ac-LTF$4rn6EYWAQL$4a5AAFa-NH2 |
| 219 | Ac-LTF$4rn6EYWAQL$4a5AAFa-NH2 |
| 220 | Ac-LTF$4rn6EYWAQL$4a5AAVa-NH2 |
| 221 | Ac-LTF$4rn6EYWAQL$4a5AAVa-NH2 |
| 222 | Ac-LTF$4rn6EHWAQL$4a5AAIa-NH2 |
| 223 | Ac-LTF$4rn6EHWAQL$4a5AAIa-NH2 |
| 224 | Ac-LTF$4rn6EHWAQL$4a5AAWa-NH2 |
| 225 | Ac-LTF$4rn6EHWAQL$4a5AAWa-NH2 |
| 226 | Ac-LTF$4rn6EHWAQL$4a5AALa-NH2 |
| 227 | Ac-LTF$4rn6EHWAQL$4a5AALa-NH2 |
| 228 | Ac-ETF$4rn6EHWVQL$4a5AALa-NH2 |
| 229 | Ac-LTF$4rn6AYWAQL$4a5AAAa-NH2 |
| 230 | Ac-LTF$4rn6AYWAQL$4a5AAAa-NH2 |
| 231 | Ac-LTF$4rn6AYWAQL$4a5AAAibA-NH2 |
| 232 | Ac-LTF$4rn6AYWAQL$4a5AAAibA-NH2 |
| 233 | Ac-LTF$4rn6AYWAQL$4a5AAAAa-NH2 |
| 234 | Ac-LTF$r5AYWAQL$4a5s8AAIa-NH2 |
| 235 | Ac-LTF$r5AYWAQL$4a5s8SAA-NH2 |
| 236 | Ac-LTF$4rn6AYWAQCba$4a5AANleA-NH2 |
| 237 | Ac-ETF$4rn6AYWAQCba$4a5AANleA-NH2 |
| 238 | Ac-LTF$4rn6EYWAQCba$4a5AANleA-NH2 |
| 239 | Ac-LTF$4rn6AYWAQCba$4a5AWNleA-NH2 |
| 240 | Ac-ETF$4rn6AYWAQCba$4a5AWNleA-NH2 |
| 241 | Ac-LTF$4rn6EYWAQCba$4a5AWNleA-NH2 |
| 242 | Ac-LTF$4rn6EYWAQCba$4a5SAFA-NH2 |
| 243 | Ac-LTF34F2$4rn6EYWAQCba$4a5SANleA-NH2 |
| 244 | Ac-LTF$4rn6EF4coohWAQCba$4a5SANleA-NH2 |
| 245 | Ac-LTF$4rn6EYWSQCba$4a5SANleA-NH2 |
| 246 | Ac-LTF$4rn6EYWWQCba$4a5SANleA-NH2 |
| 247 | Ac-LTF$4rn6EYWAQCba$4a5AAIa-NH2 |
| 248 | Ac-LTF34F2$4rn6EYWAQCba$4a5AAIa-NH2 |
| 249 | Ac-LTF$4rn6EF4coohWAQCba$4a5AAIa-NH2 |
| 250 | Pam-ETF$4rn6EYWAQCba$4a5SAA-NH2 |
| 251 | Ac-LThF$4rn6EFWAQCba$4a5SAA-NH2 |
| 252 | Ac-LTA$4rn6EYWAQCba$4a5SAA-NH2 |
| 253 | Ac-LTF$4rn6EYAAQCba$4a5SAA-NH2 |
| 254 | Ac-LTF$4rn6EY2NalAQCba$4a5SAA-NH2 |
| 255 | Ac-LTF$4rn6AYWAQCba$4a5SAA-NH2 |
| 256 | Ac-LTF$4rn6EYWAQCba$4a5SAF-NH2 |
| 257 | Ac-LTF$4rn6EYWAQCba$4a5SAFa-NH2 |
| 258 | Ac-LTF$4rn6AYWAQCba$4a5SAF-NH2 |
| 259 | Ac-LTF34F2$4rn6AYWAQCba$4a5SAF-NH2 |
| 260 | Ac-LTF$4rn6AF4coohWAQCba$4a5SAF-NH2 |
| 261 | Ac-LTF$4rn6EY6clWAQCba$4a5SAF-NH2 |
| 262 | Ac-LTF$4rn6AYWSQCba$4a5SAF-NH2 |
| 263 | Ac-LTF$4rn6AYWWQCba$4a5SAF-NH2 |
| 264 | Ac-LTF$4rn6AYWAQCba$4a5AAIa-NH2 |
| 265 | Ac-LTF34F2$4rn6AYWAQCba$4a5AAIa-NH2 |
| 266 | Ac-LTF$4rn6AY6clWAQCba$4a5AAIa-NH2 |
| 267 | Ac-LTF$4rn6AF4coohWAQCba$4a5AAIa-NH2 |
| 268 | Ac-LTF$4rn6EYWAQCba$4a5AAFa-NH2 |
| 269 | Ac-LTF$4rn6EYWAQCba$4a5AAFa-NH2 |
| 270 | Ac-ETF$4rn6EYWAQCba$4a5AWNlea-NH2 |
| 271 | Ac-LTF$4rn6EYWAQCba$4a5AWNlea-NH2 |
| 272 | Ac-ETF$4rn6EYWAQCba$4a5AWNlea-NH2 |
| 273 | Ac-ETF$4rn6EYWAQCba$4a5AWNlea-NH2 |
| 274 | Ac-LTF$4rn6AYWAQCba$4a5SAFa-NH2 |
| 275 | Ac-LTF$4rn6AYWAQCba$4a5SAFa-NH2 |
| 276 | Ac-ETF$4rn6AYWAQL$4a5AWNlea-NH2 |
| 277 | Ac-LTF$4rn6EYWAQL$4a5AWNlea-NH2 |
| 278 | Ac-ETF$4rn6EYWAQL$4a5AWNlea-NH2 |
| 279 | Dmaac-LTF$4rn6EYWAQhL$4a5SAA-NH2 |
| 280 | Hexac-LTF$4rn6EYWAQhL$4a5SAA-NH2 |
| 281 | Napac-LTF$4rn6EYWAQhL$4a5SAA-NH2 |
| 282 | Decac-LTF$4rn6EYWAQhL$4a5SAA-NH2 |
| 283 | Admac-LTF$4rn6EYWAQhL$4a5SAA-NH2 |
| 284 | Tmac-LTF$4rn6EYWAQhL$4a5SAA-NH2 |
| 285 | Pam-LTF$4rn6EYWAQhL$4a5SAA-NH2 |
| 286 | Ac-LTF$4rn6AYWAQCba$4a5AANleA-NH2 |
| 287 | Ac-LTF34F2$4rn6EYWAQCba$4a5AAIa-NH2 |
| 288 | Ac-LTF34F2$4rn6EYWAQCba$4a5SAA-NH2 |
| 289 | Ac-LTF34F2$4rn6EYWAQCba$4a5SAA-NH2 |
| 290 | Ac-LTF$4rn6EF4coohWAQCba$4a5SAA-NH2 |
| 291 | Ac-LTF$4rn6EF4coohWAQCba$4a5SAA-NH2 |
| 292 | Ac-LTF$4rn6EYWSQCba$4a5SAA-NH2 |
| 293 | Ac-LTF$4rn6EYWSQCba$4a5SAA-NH2 |
| 294 | Ac-LTF$4rn6EYWAQhL$4a5SAA-NH2 |
| 295 | Ac-LTF$4rn6AYWAQhL$4a5SAF-NH2 |
| 296 | Ac-LTF$4rn6AYWAQhL$4a5SAF-NH2 |
| 297 | Ac-LTF34F2$4rn6AYWAQhL$4a5SAA-NH2 |
| 298 | Ac-LTF34F2$4rn6AYWAQhL$4a5SAA-NH2 |
| 299 | Ac-LTF$4rn6AF4coohWAQhL$4a5SAA-NH2 |
| 300 | Ac-LTF$4rn6AF4coohWAQhL$4a5SAA-NH2 |
| 301 | Ac-LTF$4rn6AYWSQhL$4a5SAA-NH2 |
| 302 | Ac-LTF$4rn6AYWSQhL$4a5SAA-NH2 |
| 303 | Ac-LTF$4rn6EYWAQL$4a5AANleA-NH2 |
| 304 | Ac-LTF34F2$4rn6AYWAQL$4a5AANleA-NH2 |
| 305 | Ac-LTF$4rn6AF4coohWAQL$4a5AANleA-NH2 |
| 306 | Ac-LTF$4rn6AYWSQL$4a5AANleA-NH2 |
| 307 | Ac-LTF34F2$4rn6AYWAQL$4a5AANleA-NH2 |
| 308 | Ac-LTF34F2$4rn6AYWAQhL$4a5AANleA-NH2 |

TABLE 4-continued

| SP- | Sequence |
|---|---|
| 309 | Ac-LTF$4rn6AF4coohWAQhL$4a5AANleA-NH2 |
| 310 | Ac-LTF$4rn6AF4coohWAQhL$4a5AANleA-NH2 |
| 311 | Ac-LTF$4rn6AYWSQhL$4a5AANleA-NH2 |
| 312 | Ac-LTF$4rn6AYWSQhL$4a5AANleA-NH2 |
| 313 | Ac-LTF$4rn6AYWAQhL$4a5AAAAa-NH2 |
| 314 | Ac-LTF$4rn6AYWAQhL$4a5AAAAa-NH2 |
| 315 | Ac-LTF$4rn6AYWAQL$4a5AAAAAa-NH2 |
| 316 | Ac-LTF$4rn6AYWAQL$4a5AAAAAAa-NH2 |
| 317 | Ac-LTF$4rn6AYWAQL$4a5AAAAAAa-NH2 |
| 318 | Ac-LTF$4rn6EYWAQhL$4a5AANleA-NH2 |
| 319 | Ac-AATF$4rn6AYWAQL$4a5AANleA-NH2 |
| 320 | Ac-LTF$4rn6AYWAQL$4a5AANleAA-NH2 |
| 321 | Ac-ALTF$4rn6AYWAQL$4a5AANleAA-NH2 |
| 322 | Ac-LTF$4rn6AYWAQCba$4a5AANleAA-NH2 |
| 323 | Ac-LTF$4rn6AYWAQhL$4a5AANleAA-NH2 |
| 324 | Ac-LTF$4rn6EYWAQCba$4a5SAAA-NH2 |
| 325 | Ac-LTF$4rn6EYWAQCba$4a5SAAA-NH2 |
| 326 | Ac-LTF$4rn6EYWAQCba$4a5SAAAA-NH2 |
| 327 | Ac-LTF$4rn6EYWAQCba$4a5SAAAA-NH2 |
| 328 | Ac-ALTF$4rn6EYWAQCba$4a5SAAA-NH2 |
| 329 | Ac-ALTF$4rn6EYWAQCba$4a5SAAA-NH2 |
| 330 | Ac-ALTF$4rn6EYWAQCba$4a5SAA-NH2 |
| 331 | Ac-LTF$4rn6EYWAQL$4a5AAAAAa-NH2 |
| 332 | Ac-LTF$4rn6EY6clWAQCba$4a5SAA-NH2 |
| 333 | Ac-LTF$4rn6EF4cooh6clWAQCba$4a5SANleA-NH2 |
| 334 | Ac-LTF$4rn6EF4cooh6clWAQCba$4a5SANleA-NH2 |
| 335 | Ac-LTF$4rn6EF4cooh6clWAQCba$4a5AAIa-NH2 |
| 336 | Ac-LTF$4rn6EF4cooh6clWAQCba$4a5AAIa-NH2 |
| 337 | Ac-LTF$4rn6AY6clWAQL$4a5AAAAAa-NH2 |
| 338 | Ac-LTF$4rn6AY6clWAQL$4a5AAAAAa-NH2 |
| 339 | Ac-F$4rn6AY6clWEAL$4a5AAAAAAa-NH2 |
| 340 | Ac-ETF$4rn6EYWAQL$4a5AAAAAa-NH2 |
| 341 | Ac-ETF$4rn6EYWAQL$4a5AAAAAa-NH2 |
| 342 | Ac-LTF$4rn6EYWAQL$4a5AAAAAAa-NH2 |
| 343 | Ac-LTF$4rn6EYWAQL$4a5AAAAAa-NH2 |
| 344 | Ac-LTF$4rn6AYWAQL$4a5AANleAa-NH2 |
| 345 | Ac-LTF$4rn6AYWAQL$4a5AANleAAa-NH2 |
| 346 | Ac-LTF$4rn6EYWAQCba$4a5AAAAAa-NH2 |
| 347 | Ac-LTF$4rn6EYWAQCba$4a5AAAAAa-NH2 |
| 348 | Ac-LTF$4rn6EF4coohWAQCba$4a5AAAAAa-NH2 |
| 349 | Ac-LTF$4rn6EF4coohWAQCba$4a5AAAAAa-NH2 |
| 350 | Ac-LTF$4rn6EYWSQCba$4a5AAAAAa-NH2 |
| 351 | Ac-LTF$4rn6EYWSQCba$4a5AAAAAa-NH2 |
| 352 | Ac-LTF$4rn6EYWAQCba$4a5SAAa-NH2 |
| 353 | Ac-LTF$4rn6EYWAQCba$4a5SAAa-NH2 |
| 354 | Ac-ALTF$4rn6EYWAQCba$4a5SAAa-NH2 |
| 355 | Ac-ALTF$4rn6EYWAQCba$4a5SAAa-NH2 |
| 356 | Ac-ALTF$4rn6EYWAQCba$4a5SAAAa-NH2 |
| 357 | Ac-ALTF$4rn6EYWAQCba$4a5SAAAa-NH2 |
| 358 | Ac-AALTF$4rn6EYWAQCba$4a5SAAAa-NH2 |
| 359 | Ac-AALTF$4rn6EYWAQCba$4a5SAAAa-NH2 |
| 360 | Ac-RTF$4rn6EYWAQCba$4a5SAA-NH2 |
| 361 | Ac-LRF$4rn6EYWAQCba$4a5SAA-NH2 |
| 362 | Ac-LTF$4rn6EYWRQCba$4a5SAA-NH2 |
| 363 | Ac-LTF$4rn6EYWARCba$4a5SAA-NH2 |
| 364 | Ac-LTF$4rn6EYWAQCba$4a5RAA-NH2 |
| 365 | Ac-LTF$4rn6EYWAQCba$4a5SRA-NH2 |
| 366 | Ac-LTF$4rn6EYWAQCba$4a5SAR-NH2 |
| 367 | 5-FAM-BaLTF$4rn6EYWAQCba$4a5SAA-NH2 |
| 368 | 5-FAM-BaLTF$4rn6AYWAQL$4a5AANleA-NH2 |
| 369 | Ac-LAF$4rn6EYWAQL$4a5AANleA-NH2 |
| 370 | Ac-ATF$4rn6EYWAQL$4a5AANleA-NH2 |
| 371 | Ac-AAF$4rn6EYWAQL$4a5AANleA-NH2 |
| 372 | Ac-AAAF$4rn6EYWAQL$4a5AANleA-NH2 |
| 373 | Ac-AAAAF$4rn6EYWAQL$4a5AANleA-NH2 |
| 374 | Ac-AATF$4rn6EYWAQL$4a5AANleA-NH2 |
| 375 | Ac-AALTF$4rn6EYWAQL$4a5AANleA-NH2 |
| 376 | Ac-AAALTF$4rn6EYWAQL$4a5AANleA-NH2 |
| 377 | Ac-LTF$4rn6EYWAQL$4a5AANleAA-NH2 |
| 378 | Ac-ALTF$4rn6EYWAQL$4a5AANleAA-NH2 |
| 379 | Ac-AALTF$4rn6EYWAQL$4a5AANleAA-NH2 |
| 380 | Ac-LTF$4rn6EYWAQCba$4a5AANleAA-NH2 |
| 381 | Ac-LTF$4rn6EYWAQhL$4a5AANleAA-NH2 |
| 382 | Ac-ALTF$4rn6EYWAQhL$4a5AANleAA-NH2 |
| 383 | Ac-LTF$4rn6ANmYWAQL$4a5AANleA-NH2 |
| 384 | Ac-LTF$4rn6ANmYWAQL$4a5AANleA-NH2 |
| 385 | Ac-LTF$4rn6AYNmWAQL$4a5AANleA-NH2 |
| 386 | Ac-LTF$4rn6AYNmWAQL$4a5AANleA-NH2 |
| 387 | Ac-LTF$4rn6AYAmwAQL$4a5AANleA-NH2 |
| 388 | Ac-LTF$4rn6AYAmwAQL$4a5AANleA-NH2 |
| 389 | Ac-LTF$4rn6AYWAibQL$4a5AANleA-NH2 |
| 390 | Ac-LTF$4rn6AYWAibQL$4a5AANleA-NH2 |
| 391 | Ac-LTF$4rn6AYWAQL$4a5AAibNleA-NH2 |
| 392 | Ac-LTF$4rn6AYWAQL$4a5AAibNleA-NH2 |
| 393 | Ac-LTF$4rn6AYWAQL$4a5AaNleA-NH2 |
| 394 | Ac-LTF$4rn6AYWAQL$4a5AaNleA-NH2 |
| 395 | Ac-LTF$4rn6AYWAQL$4a5ASarNleA-NH2 |
| 396 | Ac-LTF$4rn6AYWAQL$4a5ASarNleA-NH2 |
| 397 | Ac-LTF$4rn6AYWAQL$4a5AANleAib-NH2 |
| 398 | Ac-LTF$4rn6AYWAQL$4a5AANleAib-NH2 |
| 399 | Ac-LTF$4rn6AYWAQL$4a5AANleNmA-NH2 |
| 400 | Ac-LTF$4rn6AYWAQL$4a5AANleNmA-NH2 |
| 401 | Ac-LTF$4rn6AYWAQL$4a5AANleSar-NH2 |
| 402 | Ac-LTF$4rn6AYWAQL$4a5AANleSar-NH2 |
| 403 | Ac-LTF$4rn6AYWAQL$4a5AANleAAib-NH2 |
| 404 | Ac-LTF$4rn6AYWAQL$4a5AANleAAib-NH2 |
| 405 | Ac-LTF$4rn6AYWAQL$4a5AANleANmA-NH2 |
| 406 | Ac-LTF$4rn6AYWAQL$4a5AANleANmA-NH2 |
| 407 | Ac-LTF$4rn6AYWAQL$4a5AANleAa-NH2 |
| 408 | Ac-LTF$4rn6AYWAQL$4a5AANleAa-NH2 |
| 409 | Ac-LTF$4rn6AYWAQL$4a5AANleASar-NH2 |
| 410 | Ac-LTF$4rn6AYWAQL$4a5AANleASar-NH2 |
| 413 | Ac-LTF$4rn6Cou4YWAQL$4a5AANleA-NH2 |
| 414 | Ac-LTF$4rn6Cou4YWAQL$4a5AANleA-NH2 |
| 415 | Ac-LTF$4rn6AYWCou4QL$4a5AANleA-NH2 |
| 416 | Ac-LTF$4rn6AYWAQL$4a5Cou4ANleA-NH2 |
| 417 | Ac-LTF$4rn6AYWAQL$4a5Cou4ANleA-NH2 |
| 418 | Ac-LTF$4rn6AYWAQL$4a5ACou4NleA-NH2 |
| 419 | Ac-LTF$4rn6AYWAQL$4a5ACou4NleA-NH2 |
| 420 | Ac-LTF$4rn6AYWAQL$4a5AANleA-OH |
| 421 | Ac-LTF$4rn6AYWAQL$4a5AANleA-OH |
| 422 | Ac-LTF$4rn6AYWAQL$4a5AANleA-NHnPr |
| 423 | Ac-LTF$4rn6AYWAQL$4a5AANleA-NHnPr |
| 424 | Ac-LTF$4rn6AYWAQL$4a5AANleA-NHnBu33Me |
| 425 | Ac-LTF$4rn6AYWAQL$4a5AANleA-NHnBu33Me |
| 426 | Ac-LTF$4rn6AYWAQL$4a5AANleA-NHHex |
| 427 | Ac-LTF$4rn6AYWAQL$4a5AANleA-NHHex |
| 428 | Ac-LTA$4rn6AYWAQL$4a5AANleA-NH2 |
| 429 | Ac-LThL$4rn6AYWAQL$4a5AANleA-NH2 |
| 430 | Ac-LTF$4rn6AYAAQL$4a5AANleA-NH2 |
| 431 | Ac-LTF$4rn6AY2NalAQL$4a5AANleA-NH2 |
| 432 | Ac-LTF$4rn6EYWCou4QCba$4a5SAA-NH2 |
| 433 | Ac-LTF$4rn6EYWCou7QCba$4a5SAA-NH2 |
| 435 | Dmaac-LTF$4rn6EYWAQCba$4a5SAA-NH2 |
| 436 | Dmaac-LTF$4rn6AYWAQL$4a5AAAAAa-NH2 |
| 437 | Dmaac-LTF$4rn6AYWAQL$4a5AAAAAa-NH2 |
| 438 | Dmaac-LTF$4rn6EYWAQL$4a5AAAAAa-NH2 |
| 439 | Dmaac-LTF$4rn6EYWAQL$4a5AAAAAa-NH2 |
| 440 | Dmaac-LTF$4rn6EF4coohWAQCba$4a5AAIa-NH2 |
| 441 | Dmaac-LTF$4rn6EF4coohWAQCba$4a5AAIa-NH2 |
| 442 | Dmaac-LTF$4rn6AYWAQL$4a5AANleA-NH2 |
| 443 | Dmaac-LTF$4rn6AYWAQL$4a5AANleA-NH2 |
| 444 | Ac-LTF$4rn6AYWAQL$4a5AANleA-NH2 |
| 445 | Ac-LTF$4rn6EYWAQL$4a5AAAAAa-NH2 |
| 446 | Cou6BaLTF$4rn6EYWAQhL$4a5SAA-NH2 |
| 447 | Cou8BaLTF$4rn6EYWAQhL$4a5SAA-NH2 |
| 448 | Ac-LTF4I$4rn6EYWAQL$4a5AAAAAa-NH2 |

TABLE 4a

| SP | Sequence | Exact Mass | Found Mass | Calc (M + 1)/1 | Calc (M + 2)/2 | Calc (M + 3)/3 |
|---|---|---|---|---|---|---|
| 449 | Ac-LTF$4rn6AYWAQL$4a5AANleA-NH2 | 1812.01 | 907.89 | 1813.02 | 907.01 | 605.01 |
| 450 | Ac-LTF$4rn6AYWAQL$4a5AAAAAa-NH2 | 1912.04 | 957.75 | 1913.05 | 957.03 | 638.35 |
| 451 | Ac-LTF$4rn6EYWAQL$4a5AAAAAa-NH2 | 1970.04 | 986.43 | 1971.05 | 986.03 | 657.69 |
| 452 | Ac-LTF$5rn6AYWAQL$5a5AAAAAa-NH2 | 1912.04 | 957.38 | 1913.05 | 957.03 | 638.35 |
| 153 | Ac-LTF$4rn6EYWAQCba$4a5SAA-NH2 | 1784.93 | 894.38 | 1785.94 | 893.47 | 595.98 |
| 454 | Ac-LTF$4rn4EYWAQCba$4a5SAA-NH2 | 1756.89 | 880.05 | 1757.9 | 879.45 | 586.64 |
| 455 | Ac-LTF$4rn5EYWAQCba$4a5SAA-NH2 | 1770.91 | 887.08 | 1771.92 | 886.46 | 591.31 |
| 456 | Ac-LTF$5rn6EYWAQCba$5a5SAA-NH2 | 1784.92 | 894.11 | 1785.93 | 893.47 | 595.98 |
| 457 | Ac-LTF$4rn6EYWAQCba5I-$4a5SAA-NH2 | 1910.82 | 957.01 | 1911.83 | 956.42 | 637.95 |
| 459 | Ac-LTA$5rn6EYWAQCba$5a5SAA-NH2 | 1708.89 | 856 | 1709.9 | 855.45 | 570.64 |
| 460 | Ac-LTA$4rn6EYWAQCba$4a5SAA-NH2 | 1708.89 | 856 | 1709.9 | 855.45 | 570.64 |
| 461 | 5-FAM-BaLTF$4rn6EYWAQCba$4a5SAA-NH2 | 2172 | 1087.81 | 2173.01 | 1087.01 | 725.01 |
| 462 | 5-FAM-BaLTA$4rn6EYWAQCba$4a5SAA-NH2 | 2095.97 | 1049.79 | 2096.98 | 1048.99 | 699.66 |
| 463 | 5-FAM-HaLTF$5rn6EYWAQCba$5a5SAA-NH2 | 2172 | 1087.53 | 2173.01 | 1087.01 | 725.01 |
| 464 | 5-FAM-BaLTA$5rn6EYWAQCba$5a5SAA-NH2 | 2095.97 | 1049.98 | 2096.98 | 1048.99 | 699.66 |
| 465 | Ac-LTF$4rn6EYWAQCba5Ph-$4a5SAA-NH2 | 1675.87 | 932.31 | 1676.88 | 931.48 | 559.63 |
| 466 | Ac-LTF$4rn6EYWAQCba5Prp-$4a5SAA-NH2 | 1675.87 | 914.46 | 1676.88 | 913.48 | 559.63 |
| 467 | Ac-LTF$4rn6AYWAAL$4a5AAAAAa-NH2 | 1855.01 | | 1856.02 | 928.51 | 619.34 |
| 468 | Ac-LTF$4rn6EYWAQCba5penNH2-$4a5SAA-NH2 | 1675.87 | | 1676.88 | 838.94 | 559.63 |
| 469 | Ac-LTF$4rn6EYWAQCba5BnzNH2-$4a5SAA-NH2 | 1675.87 | | 1676.88 | 838.94 | 559.63 |
| 470 | Ac-LTF$4rn6EYWAQCba5prpOMe-$4a5SAA-NH2 | | 929.17 | | 928.48 | |
| 932 | Ac-LTF$5rn6EYWAQL4Me$5a5AAAAAa-NH2 | 1926.05 | | 1927.06 | 964.03 | 643.02 |
| 933 | Ac-LTF$5rn6EYWAQL4Ph$5a5AAAAAa-NH2 | 1988.07 | | 1989.07 | 995.04 | 663.70 |
| 934 | Ac-LTF$5rn6EYWAQCba4Me$5a5SAANH2 | 1740.93 | | 1741.94 | 871.48 | 581.32 |
| 935 | Ac-LTF$5rn6EYWAQCba4Ph$5a5SAANH2 | 1802.95 | | 1803.96 | 902.48 | 601.99 |

In the sequences shown above and elsewhere, the following abbreviations are used: "Nle" represents norleucine, "Aib" represents 2-aminoisobutyric acid, "Ac" represents acetyl, and "Pr" represents propionyl Amino acids represented as "$" are alpha-Me S5-pentenyl-alanine olefin amino acids connected by an all-carbon crosslinker comprising one double bond Amino acids represented as "$r5" are alpha-Me R5-pentenyl-alanine olefin amino acids connected by an all-carbon comprising one double bond Amino acids represented as "$s8" are alpha-Me S8-octenyl-alanine olefin amino acids connected by an all-carbon crosslinker comprising one double bond. Amino acids represented as "$r8" are alpha-Me R8-octenyl-alanine olefin amino acids connected by an all-carbon crosslinker comprising one double bond. "Ahx" represents an aminocyclohexyl linker. The crosslinkers are linear all-carbon crosslinker comprising eight or eleven carbon atoms between the alpha carbons of each amino acid Amino acids represented as "$/" are alpha-Me S5-pentenyl-alanine olefin amino acids that are not connected by any crosslinker Amino acids represented as "$/r5" are alpha-Me R5-pentenyl-alanine olefin amino acids that are not connected by any crosslinker. Amino acids represented as "$/s8" are alpha-Me S8-octenyl-alanine olefin amino acids that are not connected by any crosslinker Amino acids represented as "$/r8" are alpha-Me R8-octenyl-alanine olefin amino acids that are not connected by any crosslinker. Amino acids represented as "Amw" are alpha-Me tryptophan amino acids Amino acids represented as "Aml" are alpha-Me leucine amino acids Amino acids represented as "Amf" are alpha-Me phenylalanine amino acids Amino acids represented as "2ff" are 2-fluoro-phenylalanine amino acids Amino acids represented as "3ff" are 3-fluoro-phenylalanine amino acids. Amino acids represented as "St" are amino acids comprising two pentenyl-alanine olefin side chains, each of which is crosslinked to another amino acid as indicated. Amino acids represented as "St//" are amino acids comprising two pentenyl-alanine olefin side chains that are not crosslinked Amino acids represented as "%St" are amino acids comprising two pentenyl-alanine olefin side chains, each of which is crosslinked to another amino acid as indicated via fully saturated hydrocarbon crosslinks. Amino acids represented as "Ba" are beta-alanine. The lower-case character "e" or "z" within the designation of a crosslinked amino acid (e.g. "$er8" or "$zr8") represents the configuration of the double bond (E or Z, respectively). In other contexts, lower-case letters such as "a" or "f" represent D amino acids (e.g. D-alanine, or D-phenylalanine, respectively). Amino acids designated as "NmW" represent N-methyltryptophan Amino acids designated as "NmY" represent N-methyltyrosine. Amino acids designated as "NmA" represent N-methylalanine. Amino acids designated as "Sar" represent sarcosine. Amino acids designated as "Cha" represent cyclohexyl alanine Amino acids designated as "Cpg" represent cyclopentyl glycine. Amino acids designated as "Chg" represent cyclohexyl glycine. Amino acids designated as "Cba" represent cyclobutyl alanine Amino acids designated as "F4I" represent 4-iodo phenylalanine. Amino acids designated as "F3Cl" represent 3-chloro phenylalanine Amino acids designated as "F4cooh" represent 4-carboxy phenylalanine Amino acids designated as "F34F2" represent 3,4-difluoro phenylalanine Amino acids designated as "6clW" represent 6-chloro tryptophan. The designation "iso1" or "iso2" indicates that the peptidomimetic macrocycle is a single isomer. "Ac3c" represents a aminocyclopropane carboxylic acid residue.

Amino acids designated as "Cou4", "Cou6", "Cou7" and "Cou8", respectively, represent the following structures:

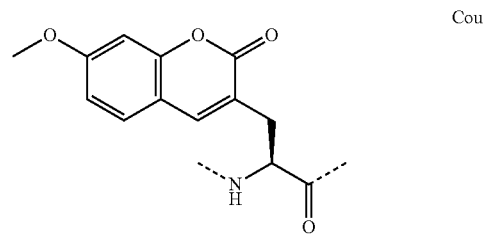

Cou

Cou2
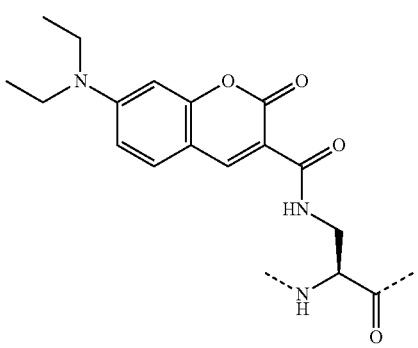

Cou3
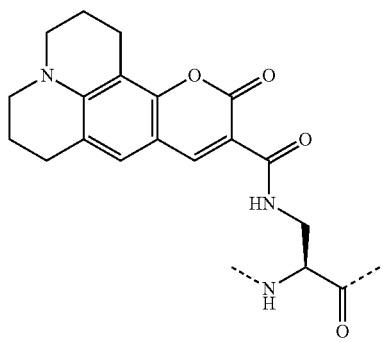

Cou4
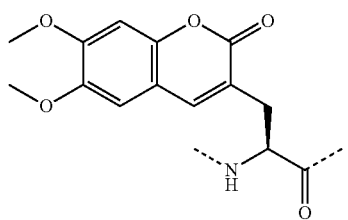

Cou6
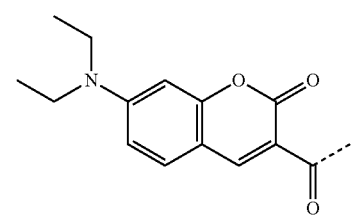

Cou7
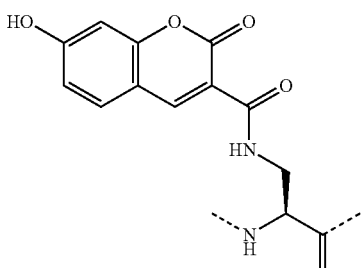

Cou8
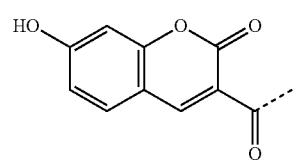

In some embodiments, a peptidomimetic macrocycle is obtained in more than one isomer, for example due to the configuration of a double bond within the structure of the crosslinker (E vs Z). Such isomers can or can not be separable by conventional chromatographic methods. In some embodiments, one isomer has improved biological properties relative to the other isomer. In one embodiment, an E crosslinker olefin isomer of a peptidomimetic macrocycle has better solubility, better target affinity, better in vivo or in vitro efficacy, higher helicity, or improved cell permeability relative to its Z counterpart. In another embodiment, a Z crosslinker olefin isomer of a peptidomimetic macrocycle has better solubility, better target affinity, better in vivo or in vitro efficacy, higher helicity, or improved cell permeability relative to its E counterpart.

Amino acids forming crosslinkers are represented according to the legend indicated below.

Stereochemistry at the alpha position of each amino acid is S unless otherwise indicated. Amino acids labeled "4Me" were prepared using an amino acid comprising an alkyne which was methyl-substituted (internal alkyne), resulting in triazole groups comprising a methyl group at the 4-position Amino acids labeled "4Ph" were prepared using an amino acid comprising an alkyne which was phenyl-substituted (internal alkyne), resulting in triazole groups comprising a phenyl group at the 4-position. For azide amino acids, the number of carbon atoms indicated refers to the number of methylene units between the alpha carbon and the terminal azide. For alkyne amino acids, the number of carbon atoms indicated is the number of methylene units between the alpha position and the triazole moiety plus the two carbon atoms within the triazole group derived from the alkyne.

| | |
|---|---|
| $5n3 | Alpha-Me azide 1,5 triazole (3 carbon) |
| #5n3 | Alpha-H azide 1,5 triazole (3 carbon) |
| $4a5 | Alpha-Me alkyne 1,4 triazole (5 carbon) |
| $4a6 | Alpha-Me alkyne 1,4 triazole (6 carbon) |
| $5a5 | Alpha-Me alkyne 1,5 triazole (5 carbon) |
| $5a6 | Alpha-Me alkyne 1,5 triazole (6 carbon) |
| #4a5 | Alpha-H alkyne 1,4 triazole (5 carbon) |
| #5a5 | Alpha-H alkyne 1,5 triazole (5 carbon) |
| $5n5 | Alpha-Me azide 1,5 triazole (5 carbon) |
| $5n6 | Alpha-Me azide 1,5 triazole (6 carbon) |
| $4n5 | Alpha-Me azide 1,4 triazole (5 carbon) |
| $4n6 | Alpha-Me azide 1,4 triazole (6 carbon) |
| $4ra5 | Alpha-Me R-alkyne 1,4 triazole (5 carbon) |
| $4ra6 | Alpha-Me R-alkyne 1,4 triazole (6 carbon) |
| $4rn4 | Alpha-Me R-azide 1,4 triazole (4 carbon) |
| $4rn5 | Alpha-Me R-azide 1,4 triazole (5 carbon) |
| $4rn6 | Alpha-Me R-azide 1,4 triazole (6 carbon) |
| $5rn5 | Alpha-Me R-azide 1,5 triazole (5 carbon) |
| $5ra5 | Alpha-Me R-alkyne 1,5 triazole (5 carbon) |
| $5ra6 | Alpha-Me R-alkyne 1,5 triazole (6 carbon) |
| $5rn6 | Alpha-Me R-azide 1,5 triazole (6 carbon) |
| #5rn6 | Alpha-H R-azide 1,5 triazole (6 carbon) |
| $4rn5 | Alpha-Me R-azide 1,4 triazole (5 carbon) |
| #4rn5 | Alpha-H R-azide 1,4 triazole (5 carbon) |
| 4Me$5rn6 | Alpha-Me R-azide 1,5 triazole (6 carbon); 4-Me substituted triazole |
| 4Me$5a5 | Alpha-Me alkyne 1,5 triazole (5 carbon); 4-Me substituted triazole |
| 4Ph$5a5 | Alpha-Me alkyne 1,5 triazole (5 carbon); 4-phenyl substituted triazole |

Amino acids designated as "5I", "5penNH2", "5BnzNH2", "5prpOMe", "5Ph", and "5prp", refer to crosslinked amino acids of the type shown in the following exemplary peptidomimetic macrocycle of Formula I:

(SEQ ID NO: 960)
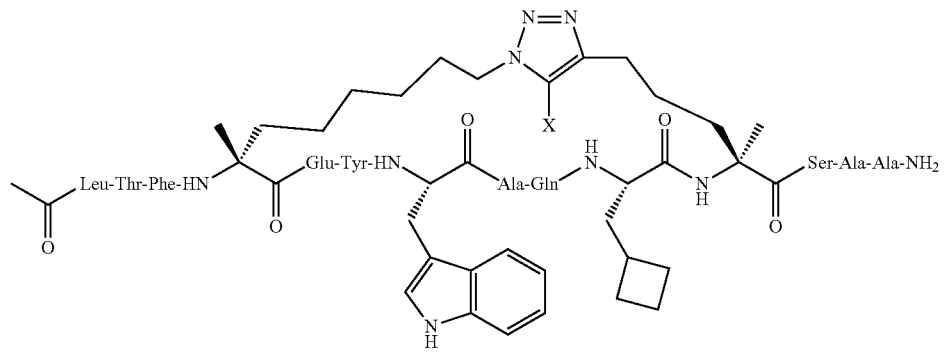
In the above structure, X is, for example, one of the following substituents:
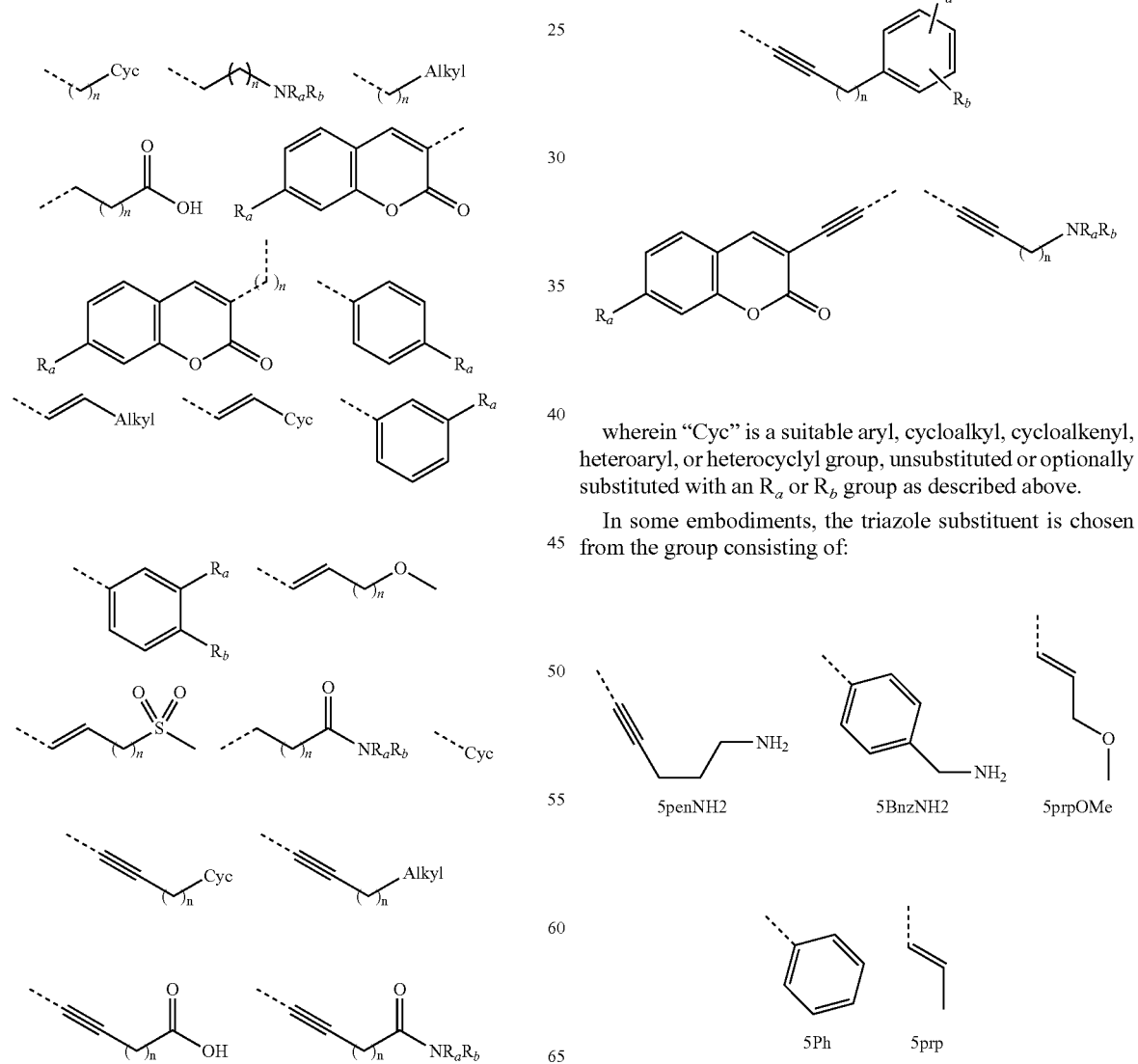
wherein "Cyc" is a suitable aryl, cycloalkyl, cycloalkenyl, heteroaryl, or heterocyclyl group, unsubstituted or optionally substituted with an $R_a$ or $R_b$ group as described above.
In some embodiments, the triazole substituent is chosen from the group consisting of:

Table 4 shows exemplary peptidomimetic macrocycles of Formula I:
TABLE 4b
Structure
SP-449
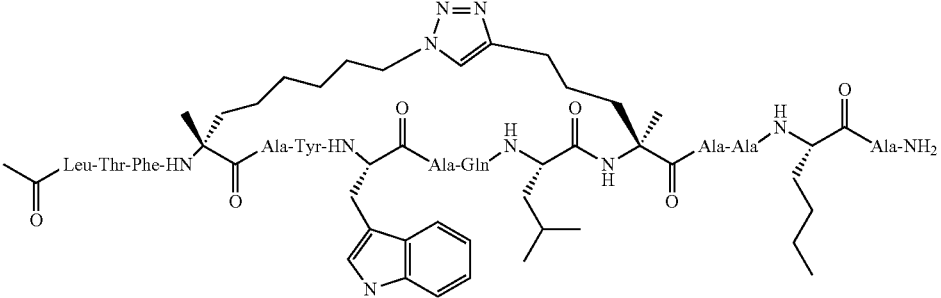
Ac-LTF$4rn6AYWAQL$4a5AANleA-NH2
Chemical Formula: $C_{90}H_{133}N_{21}O_{19}$
Exact Mass: 1812.01
Molecular Weight: 1813.15
SP-64
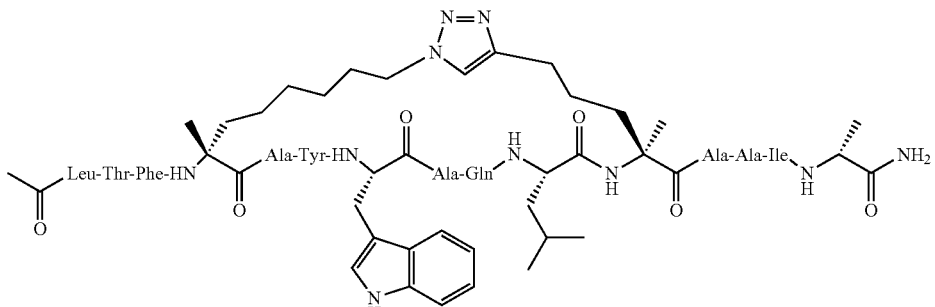
Ac-LTF$4rn6AYWAQL$4a5AAla-NH2
Chemical Formula: $C_{90}H_{133}N_{21}O_{19}$
Exact Mass: 1812.01
Molecular Weight: 1813.15
SP-153
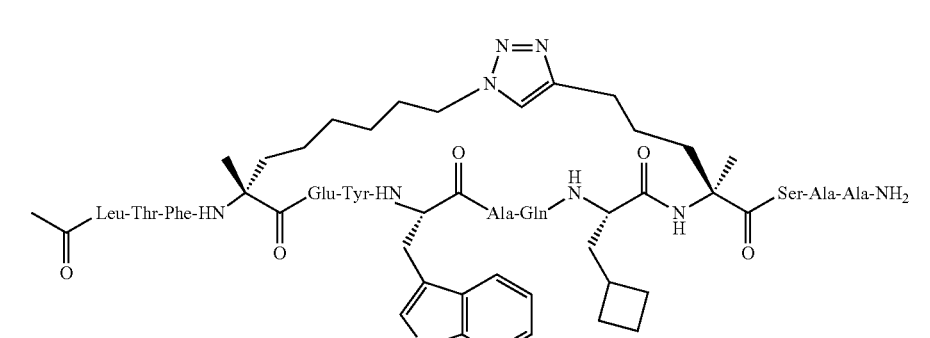
Ac-LTF$4rn6EYWAWCba$4a5SAA-NH2
Chemical Formula: $C_{87}H_{124}N_{20}O_{21}$
Exact Mass: 1784.92
Molecular Weight: 1786.04

TABLE 4b-continued
| | Structure |
|---|---|
| SP-98 | 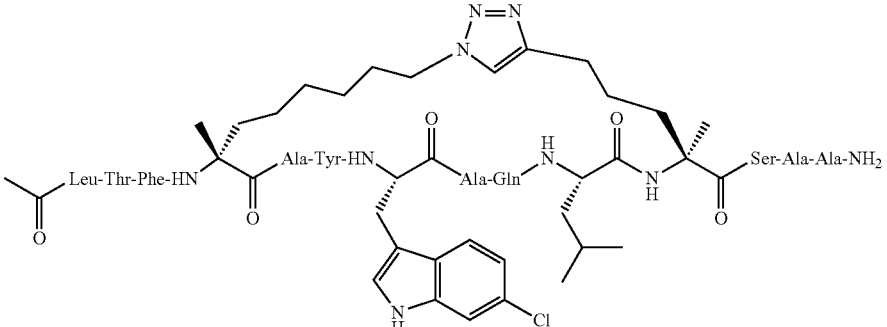
Ac-LTF$4rn6AY6clWAQL$4a5SAA-NH2
Chemical Formula: $C_{84}H_{121}ClN_{20}O_{19}$
Exact Mass: 1748.88
Molecular Weight: 1750.44 |
| SP-456 | 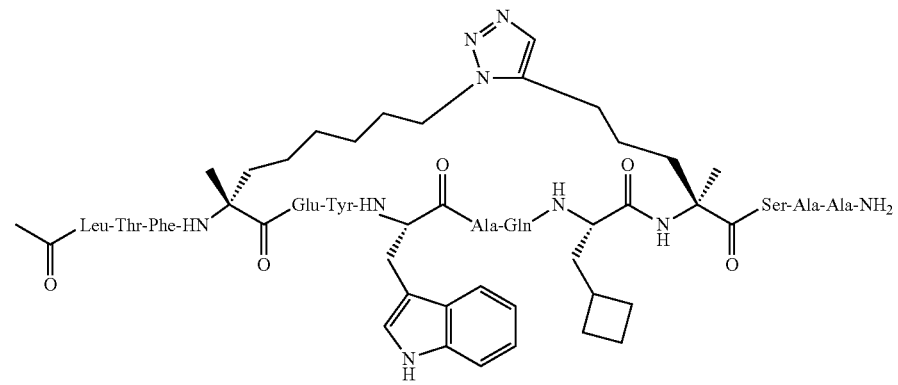
Ac-LTF$5rn6EYWAQCba$5a5SAA-NH2
Chemical Formula: $C_{87}H_{124}N_{20}O_{21}$
Exact Mass: 1784.92
Molecular Weight: 1786.04 |
| SP-470 | 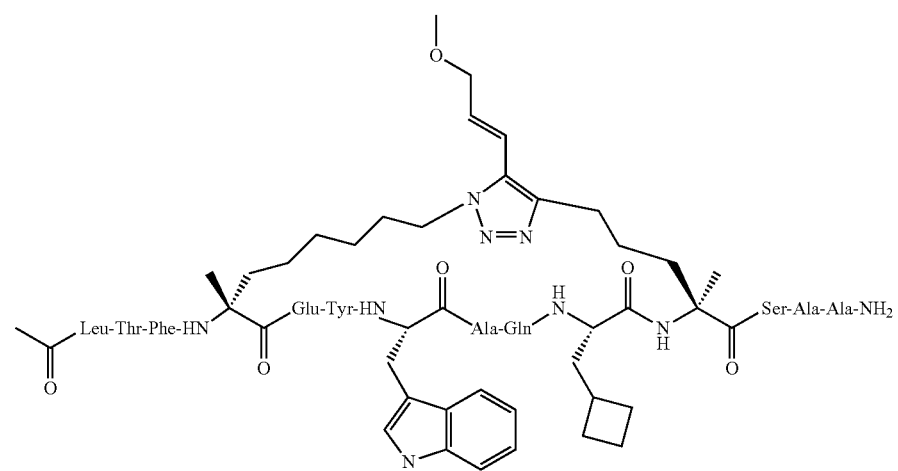 |

In some embodiments, peptidomimetic macrocycles exclude peptidomimetic macrocycles shown in Table 5:

TABLE 5

| # | Sequence |
|---|---|
| 1 | Ac-QSQQTF$5rn6NLWRLL$5a5QN-NH2 |
| 2 | Ac-QSQQTF$4rn5NLWRLL$4a5QN-NH2 |
| 3 | Ac-QSQQTF#5rn6NLWRLL#5a5QN-NH2 |
| 4 | Ac-QSQQTF#4rn5NLWRLL#4a5QN-NH2 |
| 5 | Ac-QSQQTF$5rn5NLWRLL$5a5QN-NH2 |
| 6 | Ac-QSQQTF$5ra5NLWRLL$5n5QN-NH2 |
| 7 | Ac-QSQQTF$5ra5NLWRLL$5n6QN-NH2 |
| 8 | Ac-QSQQTF$4ra5NLWRLL$4n5QN-NH2 |
| 9 | Ac-QSQQTF$4ra5NLWRLL$4n6QN-NH2 |
| 10 | Ac-QSQQTF$4rn6NLWRLL$4a5QN-NH2 |
| 11 | Ac-QSQQTF$5rn6NLWRLL$5a6QN-NH2 |
| 12 | Ac-QSQQTF$5ra6NLWRLL$5n6QN-NH2 |
| 13 | Ac-QSQQTF$4rn6NLWRLL$4a6QN-NH2 |
| 14 | Ac-QSQQTF$4ra6NLWRLL$4n6QN-NH2 |
| 15 | Ac-QSQQTF$4rn5NLWRLL$4a6QN-NH2 |
| 16 | Ac-QSQQTF4Me$5rn6NLWRLL4Me$5a5QN-NH2 |
| 17 | Ac-LTF$4ra5HYWAQL$4n6S-NH2 |
| 18 | H-F$4rn6HYWAQL$4a5S-NH2 |
| 19 | Ac-LTF$4rn6HYWAQL$4a5S-NH2 |
| 20 | Ac-F$4rn6HYWAQL$4a5S-NH2 |
| 21 | Ac-LTF$4rn6HYWAQL$4a6S-NH2 |
| 22 | Ac-LTF$5ra5HYWAQL$5n6S-NH2 |
| 23 | Ac-LTF$4rn6AYWAQL$4a5A-NH2 |
| 24 | Ac-LTF$5ra5HYWAQL$5n6S-NH2 |
| 25 | Ac-LTF$4rn6AYWAQL$4a5A-NH2 |
| 26 | Ac-LTFEHYWAQLTS-NH2 |

Peptides shown can comprise an N-terminal capping group such as acetyl or an additional linker such as beta-alanine between the capping group and the start of the peptide sequence.

In some embodiments, peptidomimetic macrocycles do not comprise a peptidomimetic macrocycle structure as shown in Table 5.

Example 3

Peptidomimetic Macrocycles of Formula II

Peptidomimetic macrocycles were designed by replacing two or more naturally occurring amino acids with the corresponding synthetic amino acids. Substitutions were made at i and i+4, and i and i+7 positions. Macrocycles were generated by solid phase peptide synthesis followed by crosslinking the peptides via their thiol-containing side chains. Peptide synthesis is performed either manually or on an automated peptide synthesizer (Applied Biosystems, model 433A), using solid phase conditions, rink amide AM resin (Novabiochem), and Fmoc main-chain protecting group chemistry. The N-termini of the synthetic peptides are acetylated, while the C-termini are amidated.

The fully protected resin-bound peptides are synthesized on a Rink amide MBHA resin (loading 0.62 mmol/g) on a 0.1 mmol scale. Deprotection of the temporary Fmoc group is achieved by 2×20 min treatments of the resin bound peptide with 25% (v/v) piperidine in NMP. After extensive flow washing with NMP and dichloromethane, coupling of each successive amino acid was achieved with 1×60 min incubation with the appropriate preactivated Fmoc-amino acid derivative. All protected amino acids (1 mmol) were dissolved in NMP and activated with HCTU (1 mmol) and DIEA (1 mmol) prior to transfer of the coupling solution to the deprotected resin-bound peptide. After coupling was completed, the resin was extensively flow washed in preparation for the next deprotection/coupling cycle. Acetylation of the amino terminus was carried out in the presence of acetic anhydride/DIEA in NMP/NMM. The LC-MS analysis of a cleaved and deprotected sample obtained from an aliquot of the fully assembled resin-bound peptide was accomplished in order to verifying the completion of each coupling.

Purification of cross-linked compounds is achieved by high performance liquid chromatography (HPLC) (Varian ProStar) on a reverse phase C18 column (Varian) to yield the pure compounds. Chemical composition of the pure products was confirmed by LC/MS mass spectrometry (Micromass LCT interfaced with Agilent 1100 HPLC system) and amino acid analysis (Applied Biosystems, model 420A).

In a typical example, a peptide resin (0.1 mmol) was washed with DCM. Deprotection of the temporary Mmt group was achieved by 3×3 min treatments of the resin bound peptide with 2% TFA/DCM 5% TIPS, then 30 min treatments until no orange color is observed in the filtrate. In between treatments the resin was extensively flow washed with DCM. After complete removal of Mmt, the resin was washed with 5% DIEA/NMP solution 3× and considered ready for bisthioether coupling. Resin was loaded into a reaction vial. DCM/DMF 1/1 was added to the reaction vessel, followed by DIEA (2.4 eq). After mixing well for 5 minutes, 4,4'-Bis(bromomethyl)biphenyl (1.05 eq) (TCI America B1921) was added. The reaction was then mechanically agitated at room temperature overnight. Where needed, the reaction was allowed additional time to reach completion. A similar procedure may be used in the preparation of five-methylene, six-methylene or seven-methylene crosslinkers ("%c7", "%c6", or "%c5").

The bisthioether resin-bound peptides were deprotected and cleaved from the solid support by treatment with TFA/$H_2O$/TIS (94/3/3 v/v) for 3 h at room temperature. After filtration of the resin the TFA solution was precipitated in cold diethyl ether and centrifuged to yield the desired product as a solid. The crude product was purified by preparative HPLC.

Table 6 show a list of peptidomimetic macrocycles.

TABLE 6

| SP | Sequence |
|---|---|
| 471 | Ac-F%cs7AYWEAc3cL%c7AAA-NH2 |
| 472 | Ac-F%cs7AYWEAc3cL%c7AAibA-NH2 |
| 473 | Ac-LTF%cs7AYWAQL%c7SANle-NH2 |
| 474 | Ac-LTF%cs7AYWAQL%c7SAL-NH2 |
| 475 | Ac-LTF%cs7AYWAQL%c7SAM-NH2 |
| 476 | Ac-LTF%cs7AYWAQL%c7SAhL-NH2 |
| 477 | Ac-LTF%cs7AYWAQL%c7SAF-NH2 |
| 478 | Ac-LTF%cs7AYWAQL%c7SAI-NH2 |
| 479 | Ac-LTF%cs7AYWAQL%c7SAChg-NH2 |
| 480 | Ac-LTF%cs7AYWAQL%c7SAAib-NH2 |
| 481 | Ac-LTF%cs7AYWAQL%c7SAA-NH2 |
| 482 | Ac-LTF%cs7AYWA%c7L%c7S%c7Nle-NH2 |
| 483 | Ac-LTF%cs7AYWA%c7L%c7S%c7A-NH2 |
| 484 | Ac-F%cs7AYWEAc3cL%c7AANle-NH2 |
| 485 | Ac-F%cs7AYWEAc3cL%c7AAL-NH2 |
| 486 | Ac-F%cs7AYWEAc3cL%c7AAM-NH2 |
| 487 | Ac-F%cs7AYWEAc3cL%c7AAhL-NH2 |
| 488 | Ac-F%cs7AYWEAc3cL%c7AAF-NH2 |
| 489 | Ac-F%cs7AYWEAc3cL%c7AAI-NH2 |
| 490 | Ac-F%cs7AYWEAc3cL%c7AAChg-NH2 |
| 491 | Ac-F%cs7AYWEAc3cL%c7AACha-NH2 |
| 492 | Ac-F%cs7AYWEAc3cL%c7AAAib-NH2 |
| 493 | Ac-LTF%cs7AYWAQL%c7AAAibV-NH2 |
| 494 | Ac-LTF%cs7AYWAQL%c7AAAibV-NH2 |
| 495 | Ac-LTF%cs7AYWAQL%c7SAibAA-NH2 |
| 496 | Ac-LTF%cs7AYWAQL%c7SAibAA-NH2 |
| 497 | Ac-HLTF%cs7HHWHQL%c7AANleNle-NH2 |
| 498 | Ac-DLTF%cs7HHWHQL%c7RRLV-NH2 |
| 499 | Ac-HHTF%cs7HHWHQL%c7AAML-NH2 |
| 500 | Ac-F%cs7HHWHQL%c7RRDCha-NH2 |
| 501 | Ac-F%cs7HHWHQL%c7HRFV-NH2 |
| 502 | Ac-HLTF%cs7HHWHQL%c7AAhLA-NH2 |

TABLE 6-continued

| SP | Sequence |
|---|---|
| 503 | Ac-DLTF%cs7HHWHQL%c7RRChgl-NH2 |
| 504 | Ac-DLTF%cs7HHWHQL%c7RRChgl-NH2 |
| 505 | Ac-HHTF%cs7HHWHQL%c7AAChav-NH2 |
| 506 | Ac-F%cs7HHWHQL%c7RRDa-NH2 |
| 507 | Ac-F%cs7HHWHQL%c7HRAibG-NH2 |
| 508 | Ac-F%cs7AYWAQL%c7HHNleL-NH2 |
| 509 | Ac-F%cs7AYWSAL%c7HQANle-NH2 |
| 510 | Ac-F%cs7AYWVQL%c7QHChgl-NH2 |
| 511 | Ac-F%cs7AYWTAL%c7QQNlev-NH2 |
| 512 | Ac-F%cs7AYWYQL%c7HAibAa-NH2 |
| 513 | Ac-LTF%cs7AYWAQL%c7HHLa-NH2 |
| 514 | Ac-LTF%cs7AYWAQL%c7HHLa-NH2 |
| 515 | Ac-LTF%cs7AYWAQL%c7HQNlev-NH2 |
| 516 | Ac-LTF%cs7AYWAQL%c7HQNlev-NH2 |
| 517 | Ac-LTF%cs7AYWAQL%c7QQMl-NH2 |
| 518 | Ac-LTF%cs7AYWAQL%c7QQMl-NH2 |
| 519 | Ac-LTF%cs7AYWAQL%c7HAibhLV-NH2 |
| 520 | Ac-LTF%cs7AYWAQL%c7AHFA-NH2 |
| 521 | Ac-HLTF%cs7HHWHQL%c7AANlel-NH2 |
| 522 | Ac-DLTF%cs7HHWHQL%c7RRLa-NH2 |
| 523 | Ac-HHTF%cs7HHWHQL%c7AAMv-NH2 |
| 524 | Ac-F%cs7HHWHQL%c7RRDA-NH2 |
| 525 | Ac-F%cs7HHWHQL%c7HRFCha-NH2 |
| 526 | Ac-F%cs7AYWEAL%c7AA-NHAm |
| 527 | Ac-F%cs7AYWEAL%c7AA-NHiAm |
| 528 | Ac-F%cs7AYWEAL%c7AA-NHnPr3Ph |
| 529 | Ac-F%cs7AYWEAL%c7AA-NHnBu33Me |
| 530 | Ac-F%cs7AYWEAL%c7AA-NHnPr |
| 531 | Ac-F%cs7AYWEAL%c7AA-NHnEt2Ch |
| 532 | Ac-F%cs7AYWEAL%c7AA-NHnEt2Cp |
| 533 | Ac-F%cs7AYWEAL%c7AA-NHHex |
| 534 | Ac-LTF%cs7AYWAQL%c7AAIA-NH2 |
| 535 | Ac-LTF%cs7AYWAQL%c7AAIA-NH2 |
| 536 | Ac-LTF%cs7AYWAAL%c7AAMA-NH2 |
| 537 | Ac-LTF%cs7AYWAAL%c7AAMA-NH2 |
| 538 | Ac-LTF%cs7AYWAQL%c7AANleA-NH2 |
| 539 | Ac-LTF%cs7AYWAQL%c7AANleA-NH2 |
| 540 | Ac-LTF%cs7AYWAQL%c7AAIa-NH2 |
| 541 | Ac-LTF%cs7AYWAQL%c7AAIa-NH2 |
| 542 | Ac-LTF%cs7AYWAQL%c7AAMa-NH2 |
| 543 | Ac-LTF%cs7AYWAAL%c7AAMa-NH2 |
| 544 | Ac-LTF%cs7AYWAQL%c7AANlea-NH2 |
| 545 | Ac-LTF%cs7AYWAQL%c7AANlea-NH2 |
| 546 | Ac-LTF%cs7AYWAQL%c7AAIv-NH2 |
| 547 | Ac-LTF%cs7AYWAAL%c7AAIv-NH2 |
| 548 | Ac-LTF%cs7AYWAQL%c7AAMv-NH2 |
| 549 | Ac-LTF%cs7AYWAAL%c7AANlev-NH2 |
| 550 | Ac-LTF%cs7AYWAQL%c7AANlev-NH2 |
| 551 | Ac-LTF%cs7AYWAQL%c7AAIl-NH2 |
| 552 | Ac-LTF%cs7AYWAQL%c7AAIl-NH2 |
| 553 | Ac-LTF%cs7AYWAAL%c7AAMl-NH2 |
| 554 | Ac-LTF%cs7AYWAQL%c7AANlel-NH2 |
| 555 | Ac-LTF%cs7AYWAQL%c7AANlel-NH2 |
| 556 | Ac-F%cs7AYWEAL%c7AAMA-NH2 |
| 557 | Ac-F%cs7AYWEAL%c7AANleA-NH2 |
| 558 | Ac-F%cs7AYWEAL%c7AAIa-NH2 |
| 559 | Ac-F%cs7AYWEAL%c7AAMa-NH2 |
| 560 | Ac-F%cs7AYWEAL%c7AANlea-NH2 |
| 561 | Ac-F%cs7AYWEAL%c7AAIv-NH2 |
| 562 | Ac-F%cs7AYWEAL%c7AAMv-NH2 |
| 563 | Ac-F%cs7AYWEAL%c7AANlev-NH2 |
| 564 | Ac-F%cs7AYWEAL%c7AAIl-NH2 |
| 565 | Ac-F%cs7AYWEAL%c7AAMl-NH2 |
| 566 | Ac-F%cs7AYWEAL%c7AANlel-NH2 |
| 567 | Ac-F%cs7AYWEAL%c7AANlel-NH2 |
| 568 | Ac-LTF%cs7AY6clWAQL%c7SAA-NH2 |
| 569 | Ac-LTF%cs7AY6clWAQL%c7SAA-NH2 |
| 570 | Ac-WTF%cs7FYWSQL%c7AVAa-NH2 |
| 571 | Ac-WTF%cs7FYWSQL%c7AVAa-NH2 |
| 572 | Ac-WTF%cs7VYWSQL%c7AVA-NH2 |
| 573 | Ac-WTF%cs7VYWSQL%c7AVA-NH2 |
| 574 | Ac-WTF%cs7FYWSQL%c7SAAa-NH2 |
| 575 | Ac-WTF%cs7FYWSQL%c7SAAa-NH2 |
| 576 | Ac-WTF%cs7VYWSQL%c7AVAaa-NH2 |
| 577 | Ac-WTF%cs7VYWSQL%c7AVAaa-NH2 |
| 578 | Ac-LTF%cs7AYWAQL%c7AVG-NH2 |
| 579 | Ac-LTF%cs7AYWAQL%c7AVG-NH2 |
| 580 | Ac-LTF%cs7AYWAQL%c7AVQ-NH2 |
| 581 | Ac-LTF%cs7AYWAQL%c7AVQ-NH2 |
| 582 | Ac-LTF%cs7AYWAQL%c7SAa-NH2 |
| 583 | Ac-LTF%cs7AYWAQL%c7SAa-NH2 |
| 584 | Ac-LTF%cs7AYWAQhL%c7SAA-NH2 |
| 585 | Ac-LTF%cs7AYWAQhL%c7SAA-NH2 |
| 586 | Ac-LTF%cs7AYWEQLStSA%c7-NH2 |
| 587 | Ac-LTF%cs7AYWAQL%c7SLA-NH2 |
| 588 | Ac-LTF%cs7AYWAQL%c7SLA-NH2 |
| 589 | Ac-LTF%cs7AYWAQL%c7SWA-NH2 |
| 590 | Ac-LTF%cs7AYWAQL%c7SWA-NH2 |
| 591 | Ac-LTF%cs7AYWAQL%c7SVS-NH2 |
| 592 | Ac-LTF%cs7AYWAQL%c7SAS-NH2 |
| 593 | Ac-LTF%cs7AYWAQL%c7SVG-NH2 |
| 594 | Ac-ETF%cs7VYWAQL%c7SAa-NH2 |
| 595 | Ac-ETF%cs7VYWAQL%c7SAA-NH2 |
| 596 | Ac-ETF%cs7VYWAQL%c7SVA-NH2 |
| 597 | Ac-ETF%cs7VYWAQL%c7SLA-NH2 |
| 598 | Ac-ETF%cs7VYWAQL%c7SWA-NH2 |
| 599 | Ac-ETF%cs7KYWAQL%c7SWA-NH2 |
| 600 | Ac-ETF%cs7VYWAQL%c7SVS-NH2 |
| 601 | Ac-ETF%cs7VYWAQL%c7SAS-NH2 |
| 602 | Ac-ETF%cs7VYWAQL%c7SVG-NH2 |
| 603 | Ac-LTF%cs7VYWAQL%c7SSa-NH2 |
| 604 | Ac-ETF%cs7VYWAQL%c7SSa-NH2 |
| 605 | Ac-LTF%cs7VYWAQL%c7SNa-NH2 |
| 606 | Ac-ETF%cs7VYWAQL%c7SNa-NH2 |
| 607 | Ac-LTF%cs7VYWAQL%c7SAa-NH2 |
| 608 | Ac-LTF%cs7VYWAQL%c7SVA-NH2 |
| 609 | Ac-LTF%cs7VYWAQL%c7SVA-NH2 |
| 610 | Ac-LTF%cs7VYWAQL%c7SWA-NH2 |
| 611 | Ac-LTF%cs7VYWAQL%c7SVS-NH2 |
| 612 | Ac-LTF%cs7VYWAQL%c7SVS-NH2 |
| 613 | Ac-LTF%cs7VYWAQL%c7SAS-NH2 |
| 614 | Ac-LTF%cs7VYWAQL%c7SAS-NH2 |
| 615 | Ac-LTF%cs7VYWAQL%c7SVG-NH2 |
| 616 | Ac-LTF%cs7VYWAQL%c7SVG-NH2 |
| 617 | Ac-LTF%cs7EYWAQCha%c7SAA-NH2 |
| 618 | Ac-LTF%cs7EYWAQCha%c7SAA-NH2 |
| 619 | Ac-LTF%cs7EYWAQCpg%c7SAA-NH2 |
| 620 | Ac-LTF%cs7EYWAQCpg%c7SAA-NH2 |
| 621 | Ac-LTF%cs7EYWAQF%c7SAA-NH2 |
| 622 | Ac-LTF%cs7EYWAQF%c7SAA-NH2 |
| 623 | Ac-LTF%cs7EYWAQCba%c7SAA-NH2 |
| 624 | Ac-LTF%cs7EYWAQCba%c7SAA-NH2 |
| 625 | Ac-LTF3Cl%cs7EYWAQL%c7SAA-NH2 |
| 626 | Ac-LTF3Cl%cs7EYWAQL%c7SAA-NH2 |
| 627 | Ac-LTF34F2%cs7EYWAQL%c7SAA-NH2 |
| 628 | Ac-LTF34F2%cs7EYWAQL%c7SAA-NH2 |
| 629 | Ac-LTF34F2%cs7EYWAQhL%c7SAA-NH2 |
| 630 | Ac-LTF34F2%cs7EYWAQhL%c7SAA-NH2 |
| 631 | Ac-ETF%cs7EYWAQL%c7SAA-NH2 |
| 632 | Ac-LTF%cs7AYWVQL%c7SAA-NH2 |
| 633 | Ac-LTF%cs7AHWAQL%c7SAA-NH2 |
| 634 | Ac-LTF%cs7AEWAQL%c7SAA-NH2 |
| 635 | Ac-LTF%cs7ASWAQL%c7SAA-NH2 |
| 636 | Ac-LTF%cs7AEWAQL%c7SAA-NH2 |
| 637 | Ac-LTF%cs7ASWAQL%c7SAA-NH2 |
| 638 | Ac-LTF%cs7AF4coohWAQL%c7SAA-NH2 |
| 639 | Ac-LTF%cs7AF4coohWAQL%c7SAA-NH2 |
| 640 | Ac-LTF%cs7AHWAQL%c7AAIa-NH2 |
| 641 | Ac-ITF%cs7FYWAQL%c7AAIa-NH2 |
| 642 | Ac-ITF%cs7EHWAQL%c7AAIa-NH2 |
| 643 | Ac-ITF%cs7EHWAQL%c7AAIa-NH2 |
| 644 | Ac-ETF%cs7EHWAQL%c7AAIa-NH2 |
| 645 | Ac-ETF%cs7EHWAQL%c7AAIa-NH2 |
| 646 | Ac-LTF%cs7AHWVQL%c7AAIa-NH2 |
| 647 | Ac-ITF%cs7FYWVQL%c7AAIa-NH2 |
| 648 | Ac-ITF%cs7EYWVQL%c7AAIa-NH2 |
| 649 | Ac-LTF%cs7EHWVQL%c7AAIa-NH2 |
| 650 | Ac-LTF%cs7AEWAQL%c7AAIa-NH2 |
| 651 | Ac-LTF%cs7AF4coohWAQL%c7AAIa-NH2 |
| 652 | Ac-LTF%cs7AF4coohWAQL%c7AAIa-NH2 |
| 653 | Ac-LTF%cs7AHWAQL%c7AHFA-NH2 |
| 654 | Ac-ITF%cs7FYWAQL%c7AHFA-NH2 |
| 655 | Ac-ITF%cs7FYWAQL%c7AHFA-NH2 |
| 656 | Ac-ITF%cs7FHWAQL%c7AEFA-NH2 |
| 657 | Ac-ITF%cs7FHWAQL%c7AEFA-NH2 |
| 658 | Ac-ITF%cs7EHWAQL%c7AHFA-NH2 |

TABLE 6-continued

| SP | Sequence |
|---|---|
| 659 | Ac-ITF%cs7EHWAQL%c7AHFA-NH2 |
| 660 | Ac-LTF%cs7AHWVQL%c7AHFA-NH2 |
| 661 | Ac-ITF%cs7FYWVQL%c7AHFA-NH2 |
| 662 | Ac-ITF%cs7EYWVQL%c7AHFA-NH2 |
| 663 | Ac-ITF%cs7EHWVQL%c7AHFA-NH2 |
| 664 | Ac-ITF%cs7EHWVQL%c7AHFA-NH2 |
| 665 | Ac-ETF%cs7EYWAAL%c7SAA-NH2 |
| 666 | Ac-LTF%cs7AYWVAL%c7SAA-NH2 |
| 667 | Ac-LTF%cs7AHWAAL%c7SAA-NH2 |
| 668 | Ac-LTF%cs7AEWAAL%c7SAA-NH2 |
| 669 | Ac-LTF%cs7AEWAAL%c7SAA-NH2 |
| 670 | Ac-LTF%cs7ASWAAL%c7SAA-NH2 |
| 671 | Ac-LTF%cs7ASWAAL%c7SAA-NH2 |
| 672 | Ac-LTF%cs7AYWAAL%c7AAIa-NH2 |
| 673 | Ac-LTF%cs7AYWAAL%c7AAIa-NH2 |
| 674 | Ac-LTF%cs7AYWAAL%c7AHFA-NH2 |
| 675 | Ac-LTF%cs7EHWAQL%c7AHIa-NH2 |
| 676 | Ac-LTF%cs7EHWAQL%c7AHIa-NH2 |
| 677 | Ac-LTF%cs7AHWAQL%c7AHIa-NH2 |
| 678 | Ac-LTF%cs7EYWAQL%c7AHIa-NH2 |
| 679 | Ac-LTF%cs7AYWAQL%c7AAFa-NH2 |
| 680 | Ac-LTF%cs7AYWAQL%c7AAFa-NH2 |
| 681 | Ac-LTF%cs7AYWAQL%c7AAWa-NH2 |
| 682 | Ac-LTF%cs7AYWAQL%c7AAVa-NH2 |
| 683 | Ac-LTF%cs7AYWAQL%c7AAVa-NH2 |
| 684 | Ac-LTF%cs7AYWAQL%c7AALa-NH2 |
| 685 | Ac-LTF%cs7AYWAQL%c7AALa-NH2 |
| 686 | Ac-LTF%cs7EYWAQL%c7AAIa-NH2 |
| 687 | Ac-LTF%cs7EYWAQL%c7AAIa-NH2 |
| 688 | Ac-LTF%cs7EYWAQL%c7AAFa-NH2 |
| 689 | Ac-LTF%cs7EYWAQL%c7AAFa-NH2 |
| 690 | Ac-LTF%cs7EYWAQL%c7AAVa-NH2 |
| 691 | Ac-LTF%cs7EYWAQL%c7AAVa-NH2 |
| 692 | Ac-LTF%cs7EHWAQL%c7AAIa-NH2 |
| 693 | Ac-LTF%cs7EHWAQL%c7AAIa-NH2 |
| 694 | Ac-LTF%cs7EHWAQL%c7AAWa-NH2 |
| 695 | Ac-LTF%cs7EHWAQL%c7AAWa-NH2 |
| 696 | Ac-LTF%cs7EHWAQL%c7AALa-NH2 |
| 697 | Ac-LTF%cs7EHWAQL%c7AALa-NH2 |
| 698 | Ac-ETF%cs7EHWVQL%c7AALa-NH2 |
| 699 | Ac-LTF%cs7AYWAQL%c7AAAa-NH2 |
| 700 | Ac-LTF%cs7AYWAQL%c7AAAa-NH2 |
| 701 | Ac-LTF%cs7AYWAQL%c7AAAibA-NH2 |
| 702 | Ac-LTF%cs7AYWAQL%c7AAAibA-NH2 |
| 703 | Ac-LTF%cs7AYWAQL%c7AAAAa-NH2 |
| 704 | Ac-LTF%c7r5AYWAQL%c7s8AAIa-NH2 |
| 705 | Ac-LTF%c7r5AYWAQL%c7s8SAA-NH2 |
| 706 | Ac-LTF%cs7AYWAQCba%c7AANleA-NH2 |
| 707 | Ac-ETF%cs7AYWAQCba%c7AANleA-NH2 |
| 708 | Ac-LTF%cs7EYWAQCba%c7AANleA-NH2 |
| 709 | Ac-LTF%cs7AYWAQCba%c7AWNleA-NH2 |
| 710 | Ac-ETF%cs7AYWAQCba%c7AWNleA-NH2 |
| 711 | Ac-LTF%cs7EYWAQCba%c7AWNleA-NH2 |
| 712 | Ac-LTF%cs7EYWAQCba%c7SAFA-NH2 |
| 713 | Ac-LTF34F2%cs7EYWAQCba%c7SANleA-NH2 |
| 714 | Ac-LTF%cs7EF4coohWAQCba%c7SANleA-NH2 |
| 715 | Ac-LTF%cs7EYWSQCba%c7SANleA-NH2 |
| 716 | Ac-LTF%cs7EYWWQCba%c7SANleA-NH2 |
| 717 | Ac-LTF%cs7EYWAQCba%c7AAIa-NH2 |
| 718 | Ac-LTF34F2%cs7EYWAQCba%c7AAIa-NH2 |
| 719 | Ac-LTF%cs7EF4coohWAQCba%c7AAIa-NH2 |
| 720 | Pam-ETF%cs7EYWAQCba%c7SAA-NH2 |
| 721 | Ac-LThF%cs7EFWAQCba%c7SAA-NH2 |
| 722 | Ac-LTA%cs7EYWAQCba%c7SAA-NH2 |
| 723 | Ac-LTF%cs7EYAAQCba%c7SAA-NH2 |
| 724 | Ac-LTF%cs7EY2NalAQCba%c7SAA-NH2 |
| 725 | Ac-LTF%cs7AYWAQCba%c7SAA-NH2 |
| 726 | Ac-LTF%cs7EYWAQCba%c7SAF-NH2 |
| 727 | Ac-LTF%cs7EYWAQCba%c7SAFa-NH2 |
| 728 | Ac-LTF%cs7AYWAQCba%c7SAF-NH2 |
| 729 | Ac-LTF34F2%cs7AYWAQCba%c7SAF-NH2 |
| 730 | Ac-LTF%cs7AF4coohWAQCba%c7SAF-NH2 |
| 731 | Ac-LTF%cs7EY6clWAQCba%c7SAF-NH2 |
| 732 | Ac-LTF%cs7AYWSQCba%c7SAF-NH2 |
| 733 | Ac-LTF%cs7AYWWQCba%c7SAF-NH2 |
| 734 | Ac-LTF%cs7AYWAQCba%c7AAIa-NH2 |
| 735 | Ac-LTF34F2%cs7AYWAQCba%c7AAIa-NH2 |
| 736 | Ac-LTF%cs7AY6clWAQCba%c7AAIa-NH2 |
| 737 | Ac-LTF%cs7AF4coohWAQCba%c7AAIa-NH2 |
| 738 | Ac-LTF%cs7EYWAQCba%c7AAFa-NH2 |
| 739 | Ac-LTF%cs7EYWAQCba%c7AAFa-NH2 |
| 740 | Ac-ETF%cs7AYWAQCba%c7AWNlea-NH2 |
| 741 | Ac-LTF%cs7EYWAQCba%c7AWNlea-NH2 |
| 742 | Ac-ETF%cs7EYWAQCba%c7AWNlea-NH2 |
| 743 | Ac-ETF%cs7EYWAQCba%c7AWNlea-NH2 |
| 744 | Ac-LTF%cs7AYWAQCba%c7SAFa-NH2 |
| 745 | Ac-LTF%cs7AYWAQCba%c7SAFa-NH2 |
| 746 | Ac-ETF%cs7AYWAQL%c7AWNlea-NH2 |
| 747 | Ac-LTF%cs7EYWAQL%c7AWNlea-NH2 |
| 748 | Ac-ETF%cs7EYWAQL%c7AWNlea-NH2 |
| 749 | Dmaac-LTF%cs7EYWAQhL%c7SAA-NH2 |
| 750 | Hexac-LTF%cs7EYWAQhL%c7SAA-NH2 |
| 751 | Napac-LTF%cs7EYWAQhL%c7SAA-NH2 |
| 752 | Decac-LTF%cs7EYWAQhL%c7SAA-NH2 |
| 753 | Admac-LTF%cs7EYWAQhL%c7SAA-NH2 |
| 754 | Tmac-LTF%cs7EYWAQhL%c7SAA-NH2 |
| 755 | Pam-LTF%cs7EYWAQhL%c7SAA-NH2 |
| 756 | Ac-LTF%cs7AYWAQCba%c7AANleA-NH2 |
| 757 | Ac-LTF34F2%cs7EYWAQCba%c7AAIa-NH2 |
| 758 | Ac-LTF34F2%cs7EYWAQCba%c7SAA-NH2 |
| 759 | Ac-LTF34F2%cs7EYWAQCba%c7SAA-NH2 |
| 760 | Ac-LTF%cs7EF4coohWAQCba%c7SAA-NH2 |
| 761 | Ac-LTF%cs7EF4coohWAQCba%c7SAA-NH2 |
| 762 | Ac-LTF%cs7EYWSQCba%c7SAA-NH2 |
| 763 | Ac-LTF%cs7EYWSQCba%c7SAA-NH2 |
| 764 | Ac-LTF%cs7EYWAQhL%c7SAA-NH2 |
| 765 | Ac-LTF%cs7AYWAQhL%c7SAF-NH2 |
| 766 | Ac-LTF%cs7AYWAQhL%c7SAF-NH2 |
| 767 | Ac-LTF34F2%cs7AYWAQhL%c7SAA-NH2 |
| 768 | Ac-LTF34F2%cs7AYWAQhL%c7SAA-NH2 |
| 769 | Ac-LTF%cs7AF4coohWAQhL%c7SAA-NH2 |
| 770 | Ac-LTF%cs7AF4coohWAQhL%c7SAA-NH2 |
| 771 | Ac-LTF%cs7AYWSQhL%c7SAA-NH2 |
| 772 | Ac-LTF%cs7AYWSQhL%c7SAA-NH2 |
| 773 | Ac-LTF%cs7EYWAQL%c7AANleA-NH2 |
| 774 | Ac-LTF34F2%cs7AYWAQL%c7AANleA-NH2 |
| 775 | Ac-LTF%cs7AF4coohWAQL%c7AANleA-NH2 |
| 776 | Ac-LTF%cs7AYWSQL%c7AANleA-NH2 |
| 777 | Ac-LTF34F2%cs7AYWAQhL%c7AANleA-NH2 |
| 778 | Ac-LTF34F2%cs7AYWAQhL%c7AANleA-NH2 |
| 779 | Ac-LTF%cs7AF4coohWAQhL%c7AANleA-NH2 |
| 780 | Ac-LTF%cs7AF4coohWAQhL%c7AANleA-NH2 |
| 781 | Ac-LTF%cs7AYWSQhL%c7AANleA-NH2 |
| 782 | Ac-LTF%cs7AYWSQhL%c7AANleA-NH2 |
| 783 | Ac-LTF%cs7AYWAQhL%c7AAAAa-NH2 |
| 784 | Ac-LTF%cs7AYWAQL%c7AAAAa-NH2 |
| 785 | Ac-LTF%cs7AYWAQL%c7AAAAAa-NH2 |
| 786 | Ac-LTF%cs7AYWAQL%c7AAAAAAa-NH2 |
| 787 | Ac-LTF%cs7AYWAQL%c7AAAAAAa-NH2 |
| 788 | Ac-LTF%cs7AYWSQhL%c7AANleA-NH2 |
| 789 | Ac-AATF%cs7AYWAQL%c7AANleA-NH2 |
| 790 | Ac-LTF%cs7AYWAQL%c7AANleAA-NH2 |
| 791 | Ac-ALTF%cs7AYWAQL%c7AANleAA-NH2 |
| 792 | Ac-LTF%cs7AYWAQCba%c7AANleAA-NH2 |
| 793 | Ac-LTF%cs7AYWAQhL%c7AANleAA-NH2 |
| 794 | Ac-LTF%cs7EYWAQCba%c7SAAA-NH2 |
| 795 | Ac-LTF%cs7EYWAQCba%c7SAAA-NH2 |
| 796 | Ac-LTF%cs7EYWAQCba%c7SAAAA-NH2 |
| 797 | Ac-LTF%cs7EYWAQCba%c7SAAAA-NH2 |
| 798 | Ac-ALTF%cs7EYWAQCba%c7SAA-NH2 |
| 799 | Ac-ALTF%cs7EYWAQCba%c7SAAA-NH2 |
| 800 | Ac-ALTF%cs7EYWAQCba%c7SAA-NH2 |
| 801 | Ac-LTF%cs7AYWAQL%c7AAAAAAa-NH2 |
| 802 | Ac-LTF%cs7EY6clWAQCba%c7SAA-NH2 |
| 803 | Ac-LTF%cs7EF4cooh6clWAQCba%c7SANleA-NH2 |
| 804 | Ac-LTF%cs7EF4cooh6clWAQCba%c7SANleA-NH2 |
| 805 | Ac-LTF%cs7EF4cooh6clWAQCba%c7AAIa-NH2 |
| 806 | Ac-LTF%cs7EF4cooh6clWAQCba%c7AAIa-NH2 |
| 807 | Ac-LTF%cs7AY6clWAQL%c7AAAAAa-NH2 |
| 808 | Ac-LTF%cs7AY6clWAQL%c7AAAAAa-NH2 |
| 809 | Ac-F%cs7AY6clWEAL%c7AAAAAa-NH2 |
| 810 | Ac-ETF%cs7EYWAQL%c7AAAAAa-NH2 |
| 811 | Ac-ETF%cs7EYWAQL%c7AAAAAa-NH2 |
| 812 | Ac-LTF%cs7EYWAQL%c7AAAAAAa-NH2 |
| 813 | Ac-LTF%cs7EYWAQL%c7AAAAAAa-NH2 |
| 814 | Ac-LTF%cs7AYWAQL%c7AANleAAa-NH2 |

TABLE 6-continued

| SP | Sequence |
|---|---|
| 815 | Ac-LTF%cs7AYWAQL%c7AANleAAa-NH2 |
| 816 | Ac-LTF%cs7EYWAQCba%c7AAAAAa-NH2 |
| 817 | Ac-LTF%cs7EYWAQCba%c7AAAAAa-NH2 |
| 818 | Ac-LTF%cs7EF4coohWAQCba%c7AAAAAa-NH2 |
| 819 | Ac-LTF%cs7EF4coohWAQCba%c7AAAAAa-NH2 |
| 820 | Ac-LTF%cs7EYWSQCba%c7AAAAAa-NH2 |
| 821 | Ac-LTF%cs7EYWSQCba%c7AAAAAa-NH2 |
| 822 | Ac-LTF%cs7EYWAQCba%c7SAAa-NH2 |
| 823 | Ac-LTF%cs7EYWAQCba%c7SAAa-NH2 |
| 824 | Ac-ALTF%cs7EYWAQCba%c7SAAa-NH2 |
| 825 | Ac-ALTF%cs7EYWAQCba%c7SAAa-NH2 |
| 826 | Ac-ALTF%cs7EYWAQCba%c7SAAa-NH2 |
| 827 | Ac-ALTF%cs7EYWAQCba%c7SAAa-NH2 |
| 828 | Ac-AALTF%cs7EYWAQCba%c7SAAAa-NH2 |
| 829 | Ac-AALTF%cs7EYWAQCba%c7SAAAa-NH2 |
| 830 | Ac-RTF%cs7EYWAQCba%c7SAA-NH2 |
| 831 | Ac-LRF%cs7EYWAQCba%c7SAA-NH2 |
| 832 | Ac-LTF%cs7EYWRQCba%c7SAA-NH2 |
| 833 | Ac-LTF%cs7EYWARCba%c7SAA-NH2 |
| 834 | Ac-LTF%cs7EYWAQCba%c7RAA-NH2 |
| 835 | Ac-LTF%cs7EYWAQCba%c7SRA-NH2 |
| 836 | Ac-LTF%cs7EYWAQCba%c7SAR-NH2 |
| 837 | 5-FAM-BaLTF%cs7EYWAQCba%c7SAA-NH2 |
| 838 | 5-FAM-BaLTF%cs7AYWAQL%c7AANleA-NH2 |
| 839 | Ac-LAF%cs7EYWAQL%c7AANleA-NH2 |
| 840 | Ac-ATF%cs7EYWAQL%c7AANleA-NH2 |
| 841 | Ac-AAF%cs7EYWAQL%c7AANleA-NH2 |
| 842 | Ac-AAAF%cs7EYWAQL%c7AANleA-NH2 |
| 843 | Ac-AAAAF%cs7EYWAQL%c7AANleA-NH2 |
| 844 | Ac-AATF%cs7EYWAQL%c7AANleA-NH2 |
| 845 | Ac-AALTF%cs7EYWAQL%c7AANleA-NH2 |
| 846 | Ac-AAALTF%cs7EYWAQL%c7AANleA-NH2 |
| 847 | Ac-LTF%cs7EYWAQL%c7AANleAA-NH2 |
| 848 | Ac-ALTF%cs7EYWAQL%c7AANleAA-NH2 |
| 849 | Ac-AALTF%cs7EYWAQL%c7AANleAA-NH2 |
| 850 | Ac-LTF%cs7EYWAQCba%c7AANleAA-NH2 |
| 851 | Ac-LTF%cs7EYWAQhL%c7AANleAA-NH2 |
| 852 | Ac-ALTF%cs7EYWAQhL%c7AANleAA-NH2 |
| 853 | Ac-LTF%cs7ANmYWAQL%c7AANleA-NH2 |
| 854 | Ac-LTF%cs7ANmYWAQL%c7AANleA-NH2 |
| 855 | Ac-LTF%cs7AYNmWAQL%c7AANleA-NH2 |
| 856 | Ac-LTF%cs7AYNmWAQL%c7AANleA-NH2 |
| 857 | Ac-LTF%cs7AYAmwAQL%c7AANleA-NH2 |
| 858 | Ac-LTF%cs7AYAmwAQL%c7AANleA-NH2 |
| 859 | Ac-LTF%cs7AYWAibQL%c7AANleA-NH2 |
| 860 | Ac-LTF%cs7AYWAibQL%c7AANleA-NH2 |
| 861 | Ac-LTF%cs7AYWAQL%c7AAibNleA-NH2 |
| 862 | Ac-LTF%cs7AYWAQL%c7AAibNleA-NH2 |
| 863 | Ac-LTF%cs7AYWAQL%c7AaNleA-NH2 |
| 864 | Ac-LTF%cs7AYWAQL%c7AaNleA-NH2 |
| 865 | Ac-LTF%cs7AYWAQL%c7ASarNleA-NH2 |
| 866 | Ac-LTF%cs7AYWAQL%c7ASarNleA-NH2 |
| 867 | Ac-LTF%cs7AYWAQL%c7AANleAib-NH2 |
| 868 | Ac-LTF%cs7EYWAQCba%c7AANleAib-NH2 |
| 869 | Ac-LTF%cs7AYWAQL%c7AANleNmA-NH2 |
| 870 | Ac-LTF%cs7AYWAQL%c7AANleNmA-NH2 |
| 871 | Ac-LTF%cs7AYWAQL%c7AANleSar-NH2 |
| 872 | Ac-LTF%cs7AYWAQL%c7AANleSar-NH2 |
| 873 | Ac-LTF%cs7AYWAQL%c7AANleAAib-NH2 |
| 874 | Ac-LTF%cs7AYWAQL%c7AANleAAib-NH2 |
| 875 | Ac-LTF%cs7AYWAQL%c7AANleANmA-NH2 |
| 876 | Ac-LTF%cs7AYWAQL%c7AANleANmA-NH2 |
| 877 | Ac-LTF%cs7AYWAQL%c7AANleAa-NH2 |
| 878 | Ac-LTF%cs7AYWAQL%c7AANleAa-NH2 |
| 879 | Ac-LTF%cs7AYWAQL%c7AANleASar-NH2 |
| 880 | Ac-LTF%cs7AYWAQL%c7AANleASar-NH2 |
| 881 | Ac-LTF%cs7/r8AYWAQL%c7/AANleA-NH2 |
| 882 | Ac-LTFAibAYWAQLAibAANleA-NH2 |
| 883 | Ac-LTF%cs7Cou4YWAQL%c7AANleA-NH2 |
| 884 | Ac-LTF%cs7Cou4YWAQL%c7AANleA-NH2 |
| 885 | Ac-LTF%cs7AYWCou4QL%c7AANleA-NH2 |
| 886 | Ac-LTF%cs7AYWAQL%c7Cou4ANleA-NH2 |
| 887 | Ac-LTF%cs7AYWAQL%c7Cou4ANleA-NH2 |
| 888 | Ac-LTF%cs7AYWAQL%c7ACou4NleA-NH2 |
| 889 | Ac-LTF%cs7AYWAQL%c7ACou4NleA-NH2 |
| 890 | Ac-LTF%cs7AYWAQL%c7AANleA-OH |
| 891 | Ac-LTF%cs7AYWAQL%c7AANleA-OH |
| 892 | Ac-LTF%cs7AYWAQL%c7AANleA-NHnPr |
| 893 | Ac-LTF%cs7AYWAQL%c7AANleA-NHnPr |
| 894 | Ac-LTF%cs7AYWAQL%c7AANleA-NHnBu33Me |
| 895 | Ac-LTF%cs7AYWAQL%c7AANleA-NHnBu33Me |
| 896 | Ac-LTF%cs7AYWAQL%c7AANleA-NHHex |
| 897 | Ac-LTF%cs7AYWAQL%c7AANleA-NHHex |
| 898 | Ac-LTA%cs7AYWAQL%c7AANleA-NH2 |
| 899 | Ac-LThL%cs7AYWAQL%c7AANleA-NH2 |
| 900 | Ac-LTF%cs7AYAAQL%c7AANleA-NH2 |
| 901 | Ac-LTF%cs7AY2NalAQL%c7AANleA-NH2 |
| 902 | Ac-LTF%cs7EYWCou4QCba%c7SAA-NH2 |
| 903 | Ac-LTF%cs7EYWCou7QCba%c7SAA-NH2 |
| 904 | Dmaac-LTF%cs7EYWAQCba%c7SAA-NH2 |
| 905 | Dmaac-LTF%cs7AYWAQL%c7AAAAAa-NH2 |
| 906 | Dmaac-LTF%cs7AYWAQL%c7AAAAAa-NH2 |
| 907 | Dmaac-LTF%cs7EYWAQL%c7AAAAAa-NH2 |
| 908 | Dmaac-LTF%cs7EYWAQL%c7AAAAAa-NH2 |
| 909 | Dmaac-LTF%cs7EF4coohWAQCba%c7AAIa-NH2 |
| 910 | Dmaac-LTF%cs7EF4coohWAQCba%c7AAIa-NH2 |
| 911 | Dmaac-LTF%cs7AYWAQL%c7AANleA-NH2 |
| 912 | Dmaac-LTF%cs7AYWAQL%c7AANleA-NH2 |
| 913 | Cou6BaLTF%cs7EYWAQhL%c7SAA-NH2 |
| 914 | Cou8BaLTF%cs7EYWAQhL%c7SAA-NH2 |
| 915 | Ac-LTF4I%cs7EYWAQL%c7AAAAAa-NH2 |

Table 6a shows exemplary peptidomimetic macrocycles:

TABLE 6a

| SP | Sequence | Exact Mass | Found Mass | Calc (M + 1)/1 | Calc (M + 2)/2 | Calc (M + 3)/3 |
|---|---|---|---|---|---|---|
| 916 | Ac-LTF%cs7AYWAQL%c7AANleA-NH2 | 1808.94 | | 1809.95 | 905.48 | 603.99 |
| 917 | Ac-LTF%cs7AYWAQL%c7AAAAAa-NH2 | 1908.96 | | 1909.97 | 955.49 | 637.33 |
| 918 | Ac-LTF%csBphAYWAQL%cBphAANleA-NH2 | 1890.92 | | 1909.97 | 955.49 | 637.33 |
| 919 | Ac-LTF%csBphAYWAQL%cBphAAAAAa-NH2 | 1990.92 | 996.88 | | | |
| 920 | Ac-LTF%csBphEYWAQCba%cBphSAA-NH2 | 1865.16 | 933.45 | | 933.58 | |
| 921 | Ac-LTF#cs7EYWAQCba#c7SAA-NH2 | 1753.82 | | 1754.83 | 877.92 | 585.61 |
| 922 | Ac-LTF#csBphEYWAQCba#cBphSAA-NH2 | 1835.81 | | 1836.82 | 918.91 | 612.94 |
| 923 | Ac-LTF%csBphEYWAQL%cBphAAAAAa-NH2 | | | | | |
| 924 | Ac-LTF%cs5AYWAQL%c5AANleA-NH2 | | | | | |
| 925 | Ac-LTF%cs5AYWAQL%c5AAAAAa-NH2 | | | | | |
| 926 | Ac-LTF%cs6AYWAQL%c6AANleA-NH2 | | | | | |
| 927 | Ac-LTF%cs6AYWAQL%c6AAAAAa-NH2 | | | | | |
| 928 | Ac-LTF%cs6EYWAQL%c6AAAAAa-NH2 | 1894.94 | | 1895.96 | 948.48 | 632.66 |
| 929 | Ac-LTF%cs5EYWAQL%c5AAAAAa-NH2 | 1880.93 | | 1881.94 | 941.47 | 627.98 |
| 930 | Ac-LTF%cs6EYWAQCba%c6SAANH2 | 1709.83 | | 1710.84 | 855.92 | 570.95 |
| 931 | Ac-LTF%cs5EYWAQCba%c5SAANH2 | 1695.81 | | 1696.82 | 848.92 | 566.28 |

Partial structures of selected exemplary peptidomimetic macrocycles are shown below:

SP-918 (SEQ ID NO: 946)

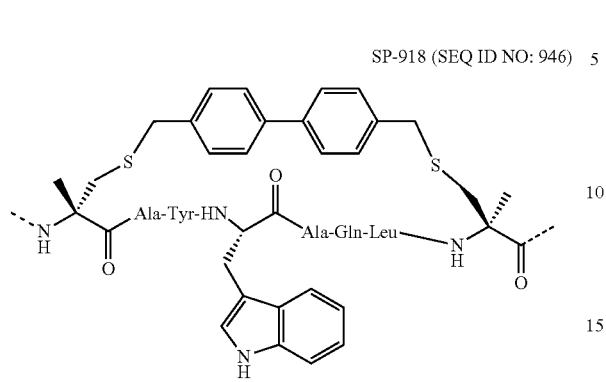

SP-916 (SEQ ID NO: 944)/917 (SEQ ID NO: 945)

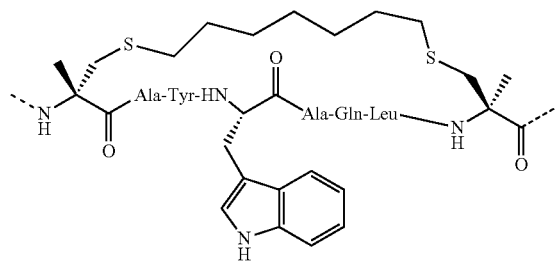

A structure of an exemplary peptidomimetic macrocycle is shown below:

SP-917 (DEQ ID NO: 945)

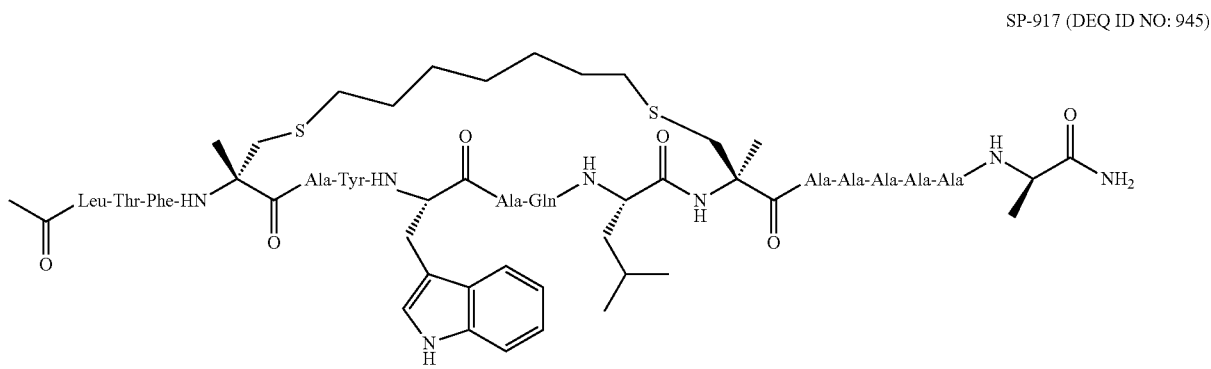

Ac-L T F %cs7 A Y W A Q L %c7 A A A A Aa-NH2

Chemical Formula: $C_{91}H_{136}N_{20}O_{21}S_2$
Exact Mass: 1908.96
Molecular Weight: 1910.30

Another structure of an exemplary peptidomimetic macrocycle is shown below:

SP-920 (SEQ ID NO: 948)

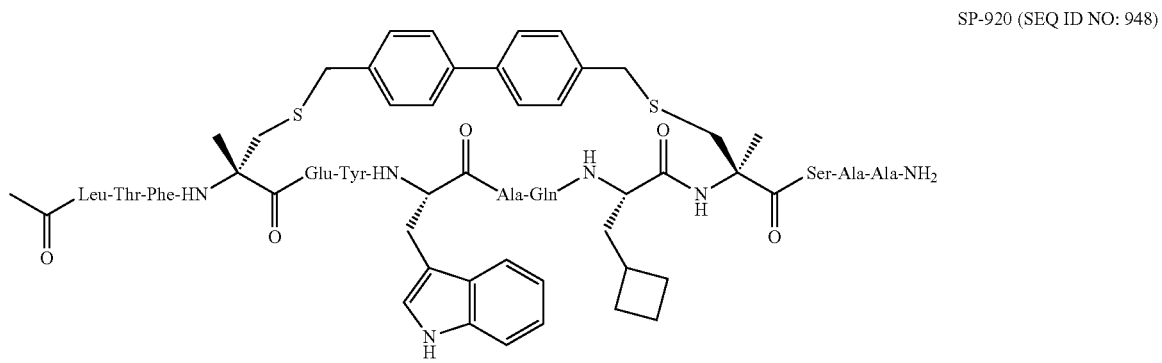

Amino acids represented as "#cs5" are D-cysteine connected by an i to i+7, five-methylene crosslinker to another thiol-containing amino acid Amino acids represented as "#c5" are L-cysteine connected by an i to i+7, five-methylene crosslinker to another thiol-containing amino acid Amino acids represented as "#cs6" are D-cysteine connected by an i to i+7, six-methylene crosslinker to another thiol-containing amino acid Amino acids represented as "#c6" are L-cysteine connected by an i to i+7, six-methylene crosslinker to another thiol-containing amino acid Amino acids represented as "#cs7" are D-cysteine connected by an i to i+7, seven-methylene crosslinker to another thiol-containing amino acid Amino acids represented as "#c7" are L-cysteine connected by an i to i+7, seven-methylene crosslinker to another thiol-containing amino acid. Amino acids represented as "#cs8" are D-cysteine connected by an i to i+7, eight-methylene crosslinker to another thiol-containing amino acid Amino acids represented as "#c8" are L-cysteine connected by an i to i+7, eight-methylene crosslinker to another thiol-containing amino acid. Amino acids represented as "%cs7" are alpha-methyl-D-cysteine connected by an i to i+7, seven-methylene crosslinker to another thiol-containing amino acid. Amino acids represented as "%c7" are alpha-methyl-L-cysteine connected by an i to i+7, seven-methylene crosslinker to another thiol-containing amino acid Amino acids represented as "%cs8" are alpha-methyl-D-cysteine connected by an i to i+7, eight-methylene crosslinker to another thiol-containing amino acid Amino acids represented as "%c8" are alpha-methyl-L-cysteine connected by an i to i+7, eight-methylene crosslinker to another thiol-containing amino acid Amino acids represented as "%cs9" are alpha-methyl-D-cysteine connected by an i to i+7, nine-methylene crosslinker to another thiol-containing amino acid Amino acids represented as "%c9" are alpha-methyl-L-cysteine connected by an i to i+7, nine-methylene crosslinker to another thiol-containing amino acid Amino acids represented as "%cs10" are alpha-methyl-D-cysteine connected by an i to i+7, ten-methylene crosslinker to another thiol-containing amino acid. Amino acids represented as "%c10" are alpha-methyl-L-cysteine connected by an i to i+7, ten-methylene crosslinker to another thiol-containing amino acid Amino acids represented as "pen8" are D-penicillamine connected by an i to i+7, eight-methylene crosslinker to another thiol-containing amino acid Amino acids represented as "Pen8" are L-penicillamine connected by an i to i+7, eight-methylene crosslinker to another thiol-containing amino acid Amino acids represented as "#csBph" are D-cysteine connected by an i to i+7, Bph (4,4'-bismethyl-biphenyl) crosslinker to another thiol-containing amino acid Amino acids represented as "#cBph" are L-cysteine connected by an i to i+7, Bph (4,4'-bismethyl-biphenyl) crosslinker to another thiol-containing amino acid Amino acids represented as "%csBph" are alpha-methyl-D-cysteine connected by an i to i+7, Bph (4,4'-bismethyl-biphenyl) crosslinker to another thiol-containing amino acid. Amino acids represented as "%cBph" are alpha-methyl-L-cysteine connected by an i to i+7, Bph (4,4'-bismethyl-biphenyl) crosslinker to another thiol-containing amino acid. Amino acids represented as "#csBpy" are D-cysteine connected by an i to i+7, Bpy (6,6'-bismethyl-[3,3']bipyridine) crosslinker to another thiol-containing amino acid Amino acids represented as "#cBpy" are L-cysteine connected by an i to i+7, Bpy (6,6'-bismethyl-[3,3']bipyridine) crosslinker to another thiol-containing amino acid Amino acids represented as "%csBpy" are alpha-methyl-D-cysteine connected by an i to i+7, Bpy (6,6'-bismethyl-[3,3']bipyridine) crosslinker to another thiol-containing amino acid Amino acids represented as "%cBpy" are alpha-methyl-L-cysteine connected by an i to i+7, Bpy (6,6'-bismethyl-[3,3']bipyridine) crosslinker to another thiol-containing amino acid. The number of methylene units indicated above refers to the number of methylene units between the two thiol groups of the crosslinker.

In some embodiments, a peptidomimetic macrocycle is obtained in more than one isomer, for example due to the configuration of a double bond within the structure of the crosslinker (E vs Z). Such isomers can or can not be separable by conventional chromatographic methods. In some embodiments, one isomer has improved biological properties relative to the other isomer. In one embodiment, an E crosslinker olefin isomer of a peptidomimetic macrocycle has better solubility, better target affinity, better in vivo or in vitro efficacy, higher helicity, or improved cell permeability relative to its Z counterpart. In another embodiment, a Z crosslinker olefin isomer of a peptidomimetic macrocycle has better solubility, better target affinity, better in vivo or in vitro efficacy, higher helicity, or improved cell permeability relative to its E counterpart.

In some embodiments, peptidomimetic macrocycles exclude peptidomimetic macrocycles shown in Table 7:

TABLE 7

| | Sequence |
|---|---|
| 1 | QSQQTF%csNLWLL%cs6QN |
| 2 | QSQQTF%csNLWLL%cs7QN |
| 3 | QSQQTF%csNLWLL%cs8QN |
| 4 | QSQQTF%csNLWLL%cs9QN |

Peptides shown can comprise an N-terminal capping group such as acetyl or an additional linker such as beta-alanine between the capping group and the start of the peptide sequence.

In some embodiments, peptidomimetic macrocycles do not comprise a peptidomimetic macrocycle structure as shown in Table 7.

In other embodiments, peptidomimetic macrocycles exclude peptidomimetic macrocycles shown in Table 7a:

TABLE 7a

| Number | Sequence |
|---|---|
| 1 | Ac-QSQQTF#cs5NLWRLL#c5QN-NH2 |
| 2 | Ac-QSQQTF#cs6NLWRLL#c6QN-NH2 |
| 3 | Ac-QSQQTF#cs7NLWRLL#c7QN-NH2 |
| 4 | Ac-QSQQTF#cs8NLWRLL#c8QN-NH2 |
| 5 | Ac-QSQQTF#cs9NLWRLL#c9QN-NH2 |
| 6 | Ac-QSQQTF%cs8NLWRLL%c8QN-NH2 |
| 7 | Ac-QSQQTF#cs8NLWRLLPen8QN-NH2 |
| 8 | Ac-QSQQTF#c8NLWRLL#c8QN-NH2 |
| 9 | Ac-QSQQTF#c8NLWRLL#cs8QN-NH2 |
| 10 | Ac-QSQQTF#cs8NLWALL#c8AN-NH2 |
| 11 | Ac-QAibQQTF#cs8NLWALL#c8AN-NH2 |
| 12 | Ac-QAibQQTF#cs8ALWALL#c8AN-NH2 |
| 13 | Ac-QSQQTFpen8NLWRLLPen8QN-NH2 |
| 14 | Ac-QSQQTFpen8NLWRLL#c8QN-NH2 |
| 15 | Ac-QSQQTF%cs9NLWRLL%c9QN-NH2 |
| 16 | Ac-LTF#cs8HYWAQL#c8S-NH2 |
| 17 | Ac-LTF#cs8HYWAQI#c8S-NH2 |
| 18 | Ac-LTF#cs8HYWAQNle#c8S-NH2 |
| 19 | Ac-LTF#cs8HYWAQL#c8A-NH2 |
| 20 | Ac-LTF#cs8HYWAbuQL#c8S-NH2 |
| 21 | Ac-LTF#cs8AYWAQL#c8S-NH2 |
| 22 | Ac-LTF#cs8AYWAQL#c8A-NH2 |
| 23 | Ac-LTF#cs8HYWAQLPen8S-NH2 |
| 24 | Ac-LTFpen8HYWAQLPen8S-NH2 |
| 25 | Ac-LTFpen8HYWAQL#c8S-NH2 |
| 26 | Ac-LTF#cs7HYWAQL#hc7S-NH2 |
| 27 | Ac-LTF%cs8HYWAQL%c8S-NH2 |
| 28 | Ac-LTF%cs9HYWAQL%c9S-NH2 |

TABLE 7a-continued

| Number | Sequence |
| --- | --- |
| 29 | Ac-LTF%cs10HYWAQL%c10S-NH2 |
| 30 | Ac-LTF%cs7HYWAQL%c7S-NH2 |
| 31 | Ac-LTF%cs4BEBHYWAQL%c4BEBS-NH2 |
| 32 | Ac-Fpen8AYWEAc3cL#c8A-NH2 |
| 33 | Ac-F#cs8AYWEAc3cL#c8A-NH2 |
| 34 | Ac-F%cs8AYWEAc3cL%c8A-NH2 |
| 35 | Ac-LTFEHYWAQLTS-NH2 |

In some embodiments, peptidomimetic macrocycles do not comprise a peptidomimetic macrocycle structure as shown in Table 7a.

In other embodiments, peptidomimetic macrocycles exclude peptidomimetic macrocycles shown in Table 7b and disclosed in Muppidi et al., Chem. Commun (2011) DOI: 10.1039/c1cc13320a:

TABLE 7b

| Number | Sequence |
| --- | --- |
| 1 | LTFEHYWAQLTS |
| 2 | LTFCHYWAQLCS |
| 3 | LTF#cBphHYWAQL#cBphS |
| 4 | LTF#cBpyHYWAQL#cBpyS |
| 5 | LTFCRYWARLCS |
| 6 | LTF#cBphRYWARL#cBphS |
| 7 | LTF#cBpyRYWARL#cBpyS |
| 8 | LTFcHYWAQLCS |
| 9 | LTF#csBphHYWAQL#cBphS |
| 10 | LTF#csBpyHYWAQL#csBpyS |
| 11 | LTF#csBphRYWARL#cBphS |
| 12 | LTF#csBpyRYWARL#cBpyS | wherein C denotes L-cysteine and c denotes D-cysteine in Table 7b; and #cBph, #cBpy, #csBph, and #csBpy are as defined herein.

In some embodiments, peptidomimetic macrocycles do not comprise a peptidomimetic macrocycle structure as shown in Table 7b.

Example 4

Circular Dichroism (CD) Analysis of Alpha-Helicity

Peptide solutions are analyzed by CD spectroscopy using a Jasco J-815 spectropolarimeter (Jasco Inc., Easton, Md.) with the Jasco Spectra Manager Ver. 2 system software. A Peltier temperature controller is used to maintain temperature control of the optical cell. Results are expressed as mean molar ellipticity [θ] (deg cm2 dmol−1) as calculated from the equation [θ]=θobs·MRW/10*l*c where θobs is the observed ellipticity in millidegrees, MRW is the mean residue weight of the peptide (peptide molecular weight/number of residues), 1 is the optical path length of the cell in centimeters, and c is the peptide concentration in mg/ml. Peptide concentrations are determined by amino acid analysis. Stock solutions of peptides are prepared in benign CD buffer (20 mM phosphoric acid, pH 2). The stocks are used to prepare peptide solutions of 0.05 mg/ml in either benign CD buffer or CD buffer with 50% trifluoroethanol (TFE) for analyses in a 10 mm pathlength cell. Variable wavelength measurements of peptide solutions are scanned at 4° C. from 195 to 250 nm, in 0.2 nm increments, and a scan rate 50 nm per minute. The average of six scans is reported.

Example 5

Direct Binding Assay MDM2 with Fluorescence Polarization (FP)

The assay is performed according to the following general protocol:

1. Dilute MDM2 (In-house, 41 kD) into FP buffer (High salt buffer-200 mM Nacl, 5 mM CHAPS, pH 7.5) to make 10 µM working stock solution.

2. Add 30 µl of 10 µM of protein stock solution into A1 and B1 well of 96-well black HE microplate (Molecular Devices).

3. Fill in 30 µl of FP buffer into column A2 to A12, B2 to B12, C1 to C12, and D1 to D12.

4. 2 or 3 fold series dilution of protein stock from A1, B1 into A2, B2; A2, B2 to A3, B3; ... to reach the single digit nM concentration at the last dilution point.

5. Dilute 1 mM (in 100% DMSO) of FAM labeled linear peptide with DMSO to 100 µM (dilution 1:10). Then, dilute from 100 µM to 10 µM with water (dilution 1:10) and then dilute with FP buffer from 10 µM to 40 nM (dilution 1:250). This is the working solution which will be a 10 nM concentration in well (dilution 1:4). Keep the diluted FAM labeled peptide in the dark until use.

6. Add 10 µl of 10 nM of FAM labeled peptide into each well and incubate, and read at different time points. Kd with 5-FAM-BaLTFEHYWAQLTS-NH$_2$ (SEQ ID NO: 1012) is ~13.38 nM.

Example 6

Competitive Fluorescence Polarization Assay for MDM2

The assay is performed according to the following general protocol:

1. Dilute MDM2 (In-house, 41 kD) into FP buffer (High salt buffer-200 mM Nacl, 5 mM CHAPS, pH 7.5) to make 84 nM (2×) working stock solution.

2. Add 20 µl of 84 nM (2×) of protein stock solution into each well of 96-well black HE microplate (Molecular Devices)

3. Dilute 1 mM (in 100% DMSO) of FAM labeled linear peptide with DMSO to 100 µM (dilution 1:10). Then, dilute from 100 µM to 10 µM with water (dilution 1:10) and then dilute with FP buffer from 10 µM to 40 nM (dilution 1:250). This is the working solution which will be a 10 nM concentration in well (dilution 1:4). Keep the diluted FAM labeled peptide in the dark until use.

4. Make unlabeled peptide dose plate with FP buffer starting with 1 µM (final) of peptide and making 5 fold serial dilutions for 6 points using following dilution scheme. Dilute 10 mM (in 100% DMSO) with DMSO to 5 mM (dilution 1:2). Then, dilute from 5 mM to 500 µM with H$_2$O (dilution 1:10) and then dilute with FP buffer from 500 µM to 20 µM (dilution 1:25). Making 5 fold serial dilutions from 4 µM (4×) for 6 points.

5. Transfer 10 µl of serial diluted unlabeled peptides to each well which is filled with 20 µl of 84 nM of protein.

6. Add 10 µl of 10 nM (4×) of FAM labeled peptide into each well and incubate for 3 hr to read.

Example 7

Direct Binding Assay MDMX with Fluorescence Polarization (FP)

The assay is performed according to the following general protocol:
1. Dilute MDMX (In-house, 40 kD) into FP buffer (High salt buffer-200 mM Nacl, 5 mM CHAPS, pH 7.5) to make 10 µM working stock solution.
2. Add 30 µl of 10 µM of protein stock solution into A1 and B1 well of 96-well black HE microplate (Molecular Devices).
3. Fill in 30 µl of FP buffer into column A2 to A12, B2 to B12, C1 to C12, and D1 to D12.
4. 2 or 3 fold series dilution of protein stock from A1, B1 into A2, B2; A2, B2 to A3, B3; . . . to reach the single digit nM concentration at the last dilution point.
5. Dilute 1 mM (in 100% DMSO) of FAM labeled linear peptide with DMSO to 100 µM (dilution 1:10). Then, dilute from 100 µM to 10 µM with water (dilution 1:10) and then dilute with FP buffer from 10 µM to 40 nM (dilution 1:250). This is the working solution which will be a 10 nM concentration in well (dilution 1:4). Keep the diluted FAM labeled peptide in the dark until use.
6. Add 10 µl of 10 nM of FAM labeled peptide into each well and incubate, and read at different time points.

Kd with 5-FAM-BaLTFEHYWAQLTS-NH$_2$ (SEQ ID NO: 1012) is ~51 nM.

Example 8

Competitive Fluorescence Polarization Assay for MDMX

The assay is performed according to the following general protocol:
1. Dilute MDMX (In-house, 40 kD) into FP buffer (High salt buffer-200 mM Nacl, 5 mM CHAPS, pH 7.5.) to make 300 nM (2×) working stock solution.
2. Add 20 µl of 300 nM (2×) of protein stock solution into each well of 96-well black HE microplate (Molecular Devices)
3. Dilute 1 mM (in 100% DMSO) of FAM labeled linear peptide with DMSO to 100 µM (dilution 1:10). Then, dilute from 100 µM to 10 µM with water (dilution 1:10) and then dilute with FP buffer from 10 µM to 40 nM (dilution 1:250). This is the working solution which will be a 10 nM concentration in well (dilution 1:4). Keep the diluted FAM labeled peptide in the dark until use.
4. Make unlabeled peptide dose plate with FP buffer starting with 5 µM (final) of peptide and making 5 fold serial dilutions for 6 points using following dilution scheme.
5. Dilute 10 mM (in 100% DMSO) with DMSO to 5 mM (dilution 1:2). Then, dilute from 5 mM to 500 µM with H$_2$O (dilution 1:10) and then dilute with FP buffer from 500 µM to 20 µM (dilution 1:25). Making 5 fold serial dilutions from 20 µM (4×) for 6 points.
6. Transfer 10 µl of serial diluted unlabeled peptides to each well which is filled with 20 µl of 300 nM of protein.
7. Add 10 µl of 10 nM (4×) of FAM labeled peptide into each well and incubate for 3 hr to read.

Results from Examples 4-7 are shown in Table 8. The following scale is used for IC50 and Ki values: "+" represents a value greater than 1000 nM, "++" represents a value greater than 100 and less than or equal to 1000 nM, "+++" represents a value greater than 10 nM and less than or equal to 100 nM, and "++++" represents a value of less than or equal to 10 nM.

Cell viability assay results (performed as in Example 9) are also included in Table 8 using the following scale: "+" represents a value greater than 30 µM, "++" represents a value greater than 15 µM and less than or equal to 30 µM, "+++" represents a value greater than 5 µM and less than or equal to 15 µM, and "++++" represents a value of less than or equal to 5 µM. "IC50 ratio" represents the ratio of average IC50 in p53+/+ cells relative to average IC50 in p53−/− cells.

TABLE 8

| SP | IC50 (MDM2) | IC50 (MDMX) | Ki (MDM2) | Ki (MDMX) | SJSA-1 EC50 (72 h) | IC50 Ratio |
|---|---|---|---|---|---|---|
| 449 | ++++ | ++++ | ++++ | ++++ | ++++ | |
| 450 | | ++ | | | +++ | |
| 451 | | +++ | | | +++ | |
| 452 | | | | | + | |
| 456 | | ++++ | +++ | | +++ | |
| 457 | | ++++ | ++++ | | ++++ | |
| 461 | | | | | +++ | |
| 459 | | + | + | | + | |
| 460 | | + | + | | + | |
| 463 | | | | | ++ | |
| 464 | | | | | + | |
| 153 | | ++++ | +++ | | ++++ | 1-29 |
| 465 | | ++++ | ++++ | | | |
| 466 | | ++++ | ++++ | | | |
| 470 | | ++++ | ++++ | | | |
| 916 | +++ | +++ | ++++ | ++++ | ++ | |
| 917 | +++ | +++ | ++++ | +++ | + | |
| 919 | | | | | +++ | |

Example 9

Competition Binding ELISA (MDM2 & MDMX)

p53-His6 protein ("His6" disclosed as SEQ ID NO: 1013) (30 nM/well) is coated overnight at room temperature in the wells of a 96-well Immulon plates. On the day of the experiment, plates are washed with 1×PBS-Tween 20 (0.05%) using an automated ELISA plate washer, blocked with ELISA Micro well Blocking for 30 minutes at room temperature; excess blocking agent is washed off by washing plates with 1×PBS-Tween 20 (0.05%). Peptides are diluted from 10 mM DMSO stocks to 500 µM working stocks in sterile water, further dilutions made in 0.5% DMSO to keep the concentration of DMSO constant across the samples. The peptides are added to wells at 2× desired concentrations in 50 µl volumes, followed by addition of diluted GST-MDM2 or GST-HMDX protein (final concentration: 10 nM). Samples are incubated at room temperature for 2 h, plates are washed with PBS-Tween 20 (0.05%) prior to adding 100 µl of HRP-conjugated anti-GST antibody [Hypromatrix, INC] diluted to 0.5 µg/ml in HRP-stabilizing buffer. Post 30 min incubation with detection antibody, plates are washed and incubated with 100 µl per well of TMB-E Substrate solution up to 30 minutes; reactions are stopped using 1M HCL and absorbance measured at 450 nm on micro plate reader. Data is analyzed using Graph Pad PRISM software.

Example 10

Cell Viability Assay

The assay is performed according to the following general protocol:
Cell Plating: Trypsinize, count and seed cells at the pre-determined densities in 96-well plates a day prior to assay. Following cell densities are used for each cell line in use:

SJSA-1: 7500 cells/well
RKO: 5000 cells/well
RKO-E6: 5000 cells/well
HCT-116: 5000 cells/well
SW-480: 2000 cells/well
MCF-7: 5000 cells/well On the day of study, replace media with fresh media with 11% FBS (assay media) at room temperature. Add 180 µL of the assay media per well. Control wells with no cells, receive 200 µl media.

Peptide dilution: all dilutions are made at room temperature and added to cells at room temperature.

Prepare 10 mM stocks of the peptides in DMSO. Serially dilute the stock using 1:3 dilution scheme to get 10, 3.3, 1.1, 0.33, 0.11, 0.03, 0.01 mM solutions using DMSO as diluents. Dilute the serially DMSO-diluted peptides 33.3 times using sterile water. This gives range of 10× working stocks. Also prepare DMSO/sterile water (3% DMSO) mix for control wells.

Thus the working stocks concentration range µM will be 300, 100, 30, 10, 3, 1, 0.3 and 0 µM. Mix well at each dilution step using multichannel Row H has controls. H1-H3 will receive 20 ul of assay media. H4-H9 will receive 20 ul of 3% DMSO-water vehicle. H10-H12 will have media alone control with no cells.

Positive control: MDM2 small molecule inhibitor, Nutlin-3a (10 mM) is used as positive control. Nutlin was diluted using the same dilution scheme as peptides.

Addition of working stocks to cells:

Add 20 µl of 10× desired concentration to appropriate well to achieve the final concentrations in total 200 µl volume in well. (20 µl of 300 µM peptide+180 µl of cells in media=30 µM final concentration in 200 µl volume in wells). Mix gently a few times using pipette. Thus final concentration range used will be 30, 10, 3, 1, 0.3, 0.1, 0.03 & 0 µM (for potent peptides further dilutions are included).

Controls include wells that get no peptides but contain the same concentration of DMSO as the wells containing the peptides, and wells containing NO CELLS.

Incubate for 72 hours at 37° C. in humidified 5% $CO_2$ atmosphere.

The viability of cells is determined using MTT reagent from Promega. Viability of SJSA-1, RKO, RKO-E6, HCT-116 cells is determined on day 3, MCF-7 cells on day 5 and SW-480 cells on day 6. At the end of designated incubation time, allow the plates to come to room temperature. Remove 80 µl of assay media from each well. Add 15 µl of thawed MTT reagent to each well.

Allow plate to incubate for 2 h at 37° C. in humidified 5% $CO_2$ atmosphere and add 100 µl solubilization reagent as per manufacturer's protocol. Incubate with agitation for 1 h at room temperature and read on Synergy Biotek multiplate reader for absorbance at 570 nM.

Analyze the cell viability against the DMSO controls using GraphPad PRISM analysis tools.

Reagents:
Invitrogen cell culture Media
i.Falcon 96-well clear cell culture treated plates (Nunc 353072)
DMSO (Sigma D 2650)
RPMI 1640 (Invitrogen 72400)
MTT (Promega G4000)
Instruments:
Multiplate Reader for Absorbance readout (Synergy 2).
Results are shown in Table 8.

Example 11

P21 ELISA Assay

The assay is performed according to the following general protocol:

Cell Plating:

Trypsinize, count and seed SJSA1 cells at the density of 7500 cells/100 µl/well in 96-well plates a day prior to assay.

On the day of study, replace media with fresh RPMI-11% FBS (assay media). Add 90 µL of the assay media per well. Control wells with no cells, receive 100 µl media.

Peptide Dilution:

Prepare 10 mM stocks of the peptides in DMSO. Serially dilute the stock using 1:3 dilution scheme to get 10, 3.3, 1.1, 0.33, 0.11, 0.03, 0.01 mM solutions using DMSO as diluents. Dilute the serially DMSO-diluted peptides 33.3 times using sterile water This gives range of 10× working stocks. Also prepare DMSO/sterile water (3% DMSO) mix for control wells.

Thus the working stocks concentration range µM will be 300, 100, 30, 10, 3, 1, 0.3 and 0 µM. Mix well at each dilution step using multichannel Row H has controls. H1-H3 will receive 10 ul of assay media. H4-H9 will receive 10 ul of 3% DMSO-water vehicle. H10-H12 will have media alone control with no cells.

Positive control: MDM2 small molecule inhibitor, Nutlin-3a (10 mM) is used as positive control. Nutlin was diluted using the same dilution scheme as peptides.

Addition of Working Stocks to Cells:

Add 10 µl of 10× desired concentration to appropriate well to achieve the final concentrations in total 100 µl volume in well. (10 µl of 300 µM peptide+90 µl of cells in media=30 µM final concentration in 100 µl volume in wells). Thus final concentration range used will be 30, 10, 3, 1, 0.3 & 0 µM.

Controls will include wells that get no peptides but contain the same concentration of DMSO as the wells containing the peptides, and wells containing NO CELLS.

20 h-post incubation, aspirate the media; wash cells with 1×PBS (without $Ca^{++}/Mg^{++}$) and lyse in 60 µl of 1× Cell lysis buffer (Cell Signaling technologies 10× buffer diluted to 1× and supplemented with protease inhibitors and Phosphatase inhibitors) on ice for 30 min.

Centrifuge plates in at 5000 rpm speed in at 4° C. for 8 min; collect clear supernatants and freeze at −80° C. till further use.

Protein Estimation:

Total protein content of the lysates is measured using BCA protein detection kit and BSA standards from Thermofisher. Typically about 6-7 µg protein is expected per well.

Use 50 µl of the lysate per well to set up p21 ELISA.

Human Total p21 ELISA:

The ELISA assay protocol is followed as per the manufacturer's instructions. 50 µl lysate is used for each well, and each well is set up in triplicate.

Reagents:
Cell-Based Assay (−)-Nutlin-3 (10 mM): Cayman Chemicals, catalog #600034
OptiMEM, Invitrogen catalog #51985
Cell Signaling Lysis Buffer (10×), Cell signaling technology, Catalog #9803
Protease inhibitor Cocktail tablets (mini), Roche Chemicals, catalog #04693124001
Phosphatase inhibitor Cocktail tablet, Roche Chemicals, catalog #04906837001
Human total p21 ELISA kit, R&D Systems, DYC1047-5

STOP Solution (1M HCL), Cell Signaling Technologies, Catalog #7002
Instruments: Micro centrifuge—Eppendorf 5415D and Multiplate Reader for Absorbance readout (Synergy 2).

Example 12

Caspase 3 Detection Assay

The assay is performed according to the following general protocol:

Cell Plating:

Trypsinize, count and seed SJSA1 cells at the density of 7500 cells/1000wed in 96-well plates a day prior to assay. On the day of study, replace media with fresh RPMI-11% FBS (assay media). Add 180 μL of the assay media per well. Control wells with no cells, receive 200 μl media.

Peptide Dilution:

Prepare 10 mM stocks of the peptides in DMSO. Serially dilute the stock using 1:3 dilution scheme to get 10, 3.3, 1.1, 0.33, 0.11, 0.03, 0.01 mM solutions using DMSO as diluents. Dilute the serially DMSO-diluted peptides 33.3 times using sterile water This gives range of 10× working stocks. Also prepare DMSO/sterile water (3% DMSO) mix for control wells.

Thus the working stocks concentration range μM will be 300, 100, 30, 10, 3, 1, 0.3 and 0 μM. Mix well at each dilution step using multichannel Add 20 ul of 10× working stocks to appropriate wells.

Row H has controls. H1-H3 will receive 20 ul of assay media. H4-H9 will receive 20 ul of 3% DMSO-water vehicle. H10-H12 will have media alone control with no cells.

Positive control: MDM2 small molecule inhibitor, Nutlin-3a (10 mM) is used as positive control. Nutlin was diluted using the same dilution scheme as peptides.

Addition of Working Stocks to Cells:

Add 10 μl of 10× desired concentration to appropriate well to achieve the final concentrations in total 100 μl volume in well. (10 μl of 300 μM peptide+90 μl of cells in media=30 μM final concentration in 100 μl volume in wells). Thus final concentration range used will be 30, 10, 3, 1, 0.3 & 0 μM.

Controls will include wells that get no peptides but contain the same concentration of DMSO as the wells containing the peptides, and wells containing NO CELLS.

48 h-post incubation, aspirate 80 μl media from each well; add 100 μl Caspase3/7Glo assay reagent (Promega Caspase 3/7 glo assay system, G8092) per well, incubate with gentle shaking for 1 h at room temperature.

read on Synergy Biotek multiplate reader for luminescence.

Data is analyzed as Caspase 3 activation over DMSO-treated cells.

Example 13

Cell Lysis by Peptidomimetic Macrocycles

SJSA-1 cells are plated out one day in advance in clear flat-bottom plates (Costar, catalog number 353072) at 7500 cells/well with 100 ul/well of growth media, leaving row H columns 10-12 empty for media alone. On the day of the assay, media was exchanged with RPMI 1% FBS media, 90 uL of media per well.

10 mM stock solutions of the peptidomimetic macrocycles are prepared in 100% DMSO. Peptidomimetic macrocycles were then diluted serially in 100% DMSO, and then further diluted 20-fold in sterile water to prepare working stock solutions in 5% DMSO/water of each peptidomimetic macrocycle at concentrations ranging from 500 uM to 62.5 uM.

10 uL of each compound is added to the 90 uL of SJSA-1 cells to yield final concentrations of 50 uM to 6.25 uM in 0.5% DMSO-containing media. The negative control (non-lytic) sample was 0.5% DMSO alone and positive control (lytic) samples include 10 uM Melittin and 1% Triton X-100.

Cell plates are incubated for 1 hour at 37 C. After the 1 hour incubation, the morphology of the cells is examined by microscope and then the plates were centrifuged at 1200 rpm for 5 minutes at room temperature. 40 uL of supernatant for each peptidomimetic macrocycle and control sample is transferred to clear assay plates. LDH release is measured using the LDH cytotoxicity assay kit from Caymen, catalog#1000882.

Example 14 p53 GRIP Assay

Thermo Scientific* BioImage p53-MDM2 Redistribution Assay monitors the protein interaction with MDM2 and cellular translocation of GFP-tagged p53 in response to drug compounds or other stimuli. Recombinant CHO-hIR cells stably express human p53(1-312) fused to the C-terminus of enhanced green fluorescent protein (EGFP) and PDE4A4-MDM2(1-124), a fusion protein between PDE4A4 and MDM2(1-124). They provide a ready-to-use assay system for measuring the effects of experimental conditions on the interaction of p53 and MDM2. Imaging and analysis is performed with a HCS platform.

CHO-hIR cells are regularly maintained in Ham's F12 media supplemented with 1% Penicillin-Streptomycin, 0.5 mg/ml Geneticin, 1 mg/ml Zeocin and 10% FBS. Cells seeded into 96-well plates at the density of 7000 cells/100 μl per well 18-24 hours prior to running the assay using culture media. The next day, media is refreshed and PD177 is added to cells to the final concentration of 3 μM to activate foci formation. Control wells are kept without PD-177 solution. 24 h post stimulation with PD177, cells are washed once with Opti-MEM Media and 50 μL of the Opti-MEM Media supplemented with PD-177 (6 μM) is added to cells. Peptides are diluted from 10 mM DMSO stocks to 500 μM working stocks in sterile water, further dilutions made in 0.5% DMSO to keep the concentration of DMSO constant across the samples. Final highest DMSO concentration is 0.5% and is used as the negative control. Cayman Chemicals Cell-Based Assay (−)-Nutlin-3 (10 mM) is used as positive control. Nutlin was diluted using the same dilution scheme as peptides. 50 μl of 2× desired concentrations is added to the appropriate well to achieve the final desired concentrations. Cells are then incubated with peptides for 6 h at 37° C. in humidified 5% CO2 atmosphere. Post-incubation period, cells are fixed by gently aspirating out the media and adding 150 μl of fixing solution per well for 20 minutes at room temperature. Fixed cells are washed 4 times with 200 μl PBS per well each time. At the end of last wash, 100 μl of 1 μM Hoechst staining solution is added. Sealed plates incubated for at least 30 min in dark, washed with PBS to remove excess stain and PBS is added to each well. Plates can be stored at 4° C. in dark up to 3 days. The translocation of p53/MDM2 is imaged using Molecular translocation module on Cellomics Arrayscan instrument using 10× objective, XF-100 filter sets for Hoechst and GFP. The output parameters was Mean-CircRINGAveIntenRatio (the ratio of average fluorescence intensities of nucleus and cytoplasm, (well average)). The minimally acceptable number of cells per well used for image analysis was set to 500 cells.

Example 15

Solubility Determination for Peptidomimetic Macrocycles

Peptidomimetic macrocycles are first dissolved in neat N,N-dimethylacetamide (DMA, Sigma-Aldrich, 38840-1L-F) to make 20× stock solutions over a concentration range of 20-140 mg/mL. The DMA stock solutions are diluted 20-fold in an aqueous vehicle containing 2% Solutol-HS-15, 25 mM Histidine, 45 mg/mL Mannitol to obtain final concentrations of 1-7 mg/ml of the peptidomimetic macrocycles in 5% DMA, 2% Solutol-HS-15, 25 mM Histidine, 45 mg/mL Mannitol. The final solutions are mixed gently by repeat pipetting or light vortexing, and then the final solutions are sonicated for 10 min at room temperature in an ultrasonic water bath. Careful visual observation is then performed under hood light using a 7× visual amplifier to determine if precipitate exists on the bottom or as a suspension. Additional concentration ranges are tested as needed to determine the maximum solubility limit for each peptidomimetic macrocycle.

---

SEQUENCE LISTING (1013 sequences)

SEQ ID NO: 1 - protein, 10 aa, Artificial Sequence
  Description of Artificial Sequence: Synthetic peptide
  MOD_RES (2)..(2): Any amino acid
  MOD_RES (9)..(9): Any amino acid
FXHYWAQLXS

SEQ ID NO: 2 - protein, 10 aa, Artificial Sequence
  Description of Artificial Sequence: Synthetic peptide
  MOD_RES (2)..(2): Any amino acid
  MOD_RES (8)..(8): Leu or Cyclobutyl-Ala
  MOD_RES (9)..(9): Any amino acid
FXEYWAQXXA

SEQ ID NO: 3 - protein, 12 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me alkyne 1,4 triazole (5 carbon) alanine olefin amino acid connected by an all-carbon crosslinker comprising one double bond
  C-term NH2
FAAYWEXLAAAA

SEQ ID NO: 4 - protein, 12 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me alkyne 1,4 triazole (5 carbon) alanine olefin amino acid connected by an all-carbon crosslinker comprising one double bond
  MOD_RES (11)..(11): 2-aminoisobutyric acid
  C-term NH2
FAAYWEXLAAXA

SEQ ID NO: 5 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLASAL

SEQ ID NO: 6 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASAL

SEQ ID NO: 7 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASAM

SEQ ID NO: 8 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): homo-Leu
  C-term NH2
LTFAAYWAQLASAL

SEQ ID NO: 9 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASAF

SEQ ID NO: 10 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASAI

SEQ ID NO: 11 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Cyclohexyl-Gly
  C-term NH2
LTFAAYWAQLASAG

SEQ ID NO: 12 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): 2-aminoisobutyric acid
  C-term NH2
LTFAAYWAQLASAX

SEQ ID NO: 13 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASAA

SEQ ID NO: 14 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (11)..(11): Alpha-Me S5-pentenyl-alanine olefin amino acid connected by an all-carbon crosslinker comprising one double bond
  misc_feature (11)..(13): Crosslink between residues
  MOD_RES (13)..(13): Alpha-Me S5-pentenyl-alanine olefin amino acid connected by an all-carbon crosslinker comprising one double bond
  MOD_RES (14)..(14): Norleucine
  C-term NH2
LTFAAYWAALASAL

SEQ ID NO: 15 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (11)..(11): Alpha-Me S5-pentenyl-alanine olefin amino acid connected by an all-carbon crosslinker comprising one double bond
  misc_feature (11)..(13): Crosslink between residues
  MOD_RES (13)..(13): Alpha-Me S5-pentenyl-alanine olefin amino acid connected by an all-carbon crosslinker comprising one double bond
  C-term NH2
LTFAAYWAALASAA

SEQ ID NO: 16 - protein, 12 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me alkyne 1,4 triazole (5 carbon) alanine olefin amino acid connected by an all-carbon crosslinker comprising one double bond
  MOD_RES (12)..(12): Norleucine
  C-term NH2
FAAYWEXLAAAL

SEQ ID NO: 17 - protein, 12 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me alkyne 1,4 triazole (5 carbon) alanine olefin amino acid connected by an all-carbon crosslinker comprising one double bond
  C-term NH2
FAAYWEXLAAAL

SEQ ID NO: 18 - protein, 12 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me alkyne 1,4 triazole (5 carbon) alanine olefin amino acid connected by an all-carbon crosslinker comprising one double bond
  C-term NH2
FAAYWEXLAAAM

SEQ ID NO: 19 - protein, 12 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me alkyne 1,4 triazole (5 carbon) alanine olefin amino acid connected by an all-carbon crosslinker comprising one double bond
  MOD_RES (12)..(12): homo-Leu
  C-term NH2
FAAYWEXLAAAL

SEQ ID NO: 20 - protein, 12 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me alkyne 1,4 triazole (5 carbon) alanine olefin amino acid connected by an all-carbon crosslinker comprising one double bond
  C-term NH2
FAAYWEXLAAAF

SEQ ID NO: 21 - protein, 12 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me alkyne 1,4 triazole (5 carbon) alanine olefin amino acid connected by an all-carbon crosslinker comprising one double bond
  C-term NH2
FAAYWEXLAAAI

SEQ ID NO: 22 - protein, 12 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me alkyne 1,4 triazole (5 carbon) alanine olefin amino acid connected by an all-carbon crosslinker comprising one double bond
  MOD_RES (12)..(12): Cyclohexyl-Gly
  C-term NH2
FAAYWEXLAAAG

SEQ ID NO: 23 - protein, 12 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me alkyne 1,4 triazole (5 carbon) alanine olefin amino acid connected by an all-carbon crosslinker comprising one double bond
  MOD_RES (12)..(12): Cyclohexyl-Ala
  C-term NH2
FAAYWEXLAAAA

SEQ ID NO: 24 - protein, 12 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me alkyne 1,4 triazole (5 carbon) alanine olefin amino acid connected by an all-carbon crosslinker comprising one double bond
  MOD_RES (12)..(12): 2-aminoisobutyric acid
  C-term NH2
FAAYWEXLAAAX

SEQ ID NO: 25 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): 2-aminoisobutyric acid
  C-term NH2
LTFAAYWAQLAAAXV

SEQ ID NO: 26 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): 2-aminoisobutyric acid
  C-term NH2
LTFAAYWAQLAAAXV

SEQ ID NO: 27 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (13)..(13): 2-aminoisobutyric acid
  C-term NH2
LTFAAYWAQLASXAA

SEQ ID NO: 28 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (13)..(13): 2-aminoisobutyric acid
  C-term NH2
LTFAAYWAQLASXAA

SEQ ID NO: 29 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  MOD_RES (15)..(16): Norleucine
  C-term NH2
HLTFAHHWHQLAAALL

SEQ ID NO: 30 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  C-term NH2
DLTFAHHWHQLARRLV

SEQ ID NO: 31 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  C-term NH2
HHTFAHHWHQLAAAML

SEQ ID NO: 32 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (13)..(13): Cyclohexyl-Ala
  C-term NH2
FAHHWHQLARRDA

SEQ ID NO: 33 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  C-term NH2
FAHHWHQLAHRFV

SEQ ID NO: 34 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  MOD_RES (15)..(15): homo-Leu
  C-term NH2
HLTFAHHWHQLAAALA

SEQ ID NO: 35 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  MOD_RES (15)..(15): Cyclohexyl-Gly
  MOD_RES (16)..(16): D-amino acid
  C-term NH2
DLTFAHHWHQLARRGL

SEQ ID NO: 36 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  MOD_RES (15)..(15): Cyclohexyl-Gly
  MOD_RES (16)..(16): D-amino acid
  C-term NH2
DLTFAHHWHQLARRGL

SEQ ID NO: 37 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  MOD_RES (15)..(15): Cyclohexyl-Ala
  MOD_RES (16)..(16): D-amino acid
  C-term NH2
HHTFAHHWHQLAAAAV

SEQ ID NO: 38 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (13)..(13): D-amino acid
  C-term NH2
FAHHWHQLARRDA

SEQ ID NO: 39 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (12)..(12): 2-aminoisobutyric acid
  C-term NH2
FAHHWHQLAHRXG

SEQ ID NO: 40 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (12)..(12): Norleucine
  C-term NH2
FAAYWAQLAHHLL

SEQ ID NO: 41 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (13)..(13): Norleucine
  C-term NH2
FAAYWSALAHQAL

SEQ ID NO: 42 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (12)..(12): Cyclohexyl-Gly
  MOD_RES (13)..(13): D-amino acid
  C-term NH2
FAAYWVQLAQHGL

SEQ ID NO: 43 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (12)..(12): Norleucine
  MOD_RES (13)..(13): D-amino acid
  C-term NH2
FAAYWTALAQQLV

SEQ ID NO: 44 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (11)..(11): 2-aminoisobutyric acid
  MOD_RES (13)..(13): D-amino acid
  C-term NH2
FAAYWYQLAHXAA

SEQ ID NO: 45 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAHHLA

SEQ ID NO: 46 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAHHLA

SEQ ID NO: 47 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAHQLV

SEQ ID NO: 48 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAHQLV

SEQ ID NO: 49 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAQQML

SEQ ID NO: 50 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAQQML

SEQ ID NO: 51 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (13)..(13): 2-aminoisobutyric acid
  MOD_RES (14)..(14): homo-Leu
  C-term NH2
LTFAAYWAQLAHXLV

SEQ ID NO: 52 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLAAHFA

SEQ ID NO: 53 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  MOD_RES (15)..(15): Norleucine
  MOD_RES (16)..(16): D-amino acid
  C-term NH2
HLTFAHHWHQLAAALL

SEQ ID NO: 54 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  MOD_RES (16)..(16): D-amino acid
  C-term NH2
DLTFAHHWHQLARRLA

SEQ ID NO: 55 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  MOD_RES (16)..(16): D-amino acid
  C-term NH2
HHTFAHHWHQLAAAMV

SEQ ID NO: 56 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  C-term NH2
FAHHWHQLARRDA

SEQ ID NO: 57 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (13)..(13): Cyclohexyl-Ala
  C-term NH2
FAHHWHQLAHRFA

SEQ ID NO: 58 - protein, 11 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  C-term NHAm
FAAYWEALAAA

SEQ ID NO: 59 - protein, 11 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  C-term NHiAm
FAAYWEALAAA

SEQ ID NO: 60 - protein, 11 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  C-term NHnPr3Ph
FAAYWEALAAA

SEQ ID NO: 61 - protein, 11 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  C-term NHnBu33Me
FAAYWEALAAA

SEQ ID NO: 62 - protein, 11 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  C-term NHnPr
FAAYWEALAAA

SEQ ID NO: 63 - protein, 11 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  C-term NHnEt2Ch
FAAYWEALAAA

SEQ ID NO: 64 - protein, 11 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  C-term NHnEt2Cp
FAAYWEALAAA

SEQ ID NO: 65 - protein, 11 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  C-term NHHex
FAAYWEALAAA

SEQ ID NO: 66 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLAAAIA

SEQ ID NO: 67 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLAAAIA

SEQ ID NO: 68 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAALAAAMA

SEQ ID NO: 69 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAALAAAMA

SEQ ID NO: 70 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLAAALA

SEQ ID NO: 71 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLAAALA

SEQ ID NO: 72 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAAAIA

SEQ ID NO: 73 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAAAIA

SEQ ID NO: 74 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAALAAAMA

SEQ ID NO: 75 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAALAAAMA

SEQ ID NO: 76 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAAALA

SEQ ID NO: 77 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAAALA

SEQ ID NO: 78 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAALAAAIV

SEQ ID NO: 79 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAALAAAIV

SEQ ID NO: 80 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAAAMV

SEQ ID NO: 81 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): D-amino acid
  C-term NH2
LTFAAYWAALAAALV

SEQ ID NO: 82 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): D-amino acid
  C-term NH2
LTFAAYWAALAAALV

SEQ ID NO: 83 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAAAIL

SEQ ID NO: 84 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAAAIL

SEQ ID NO: 85 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAALAAAML

SEQ ID NO: 86 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAAALL

SEQ ID NO: 87 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAAALL

SEQ ID NO: 88 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  C-term NH2
FAAYWEALAAAMA

SEQ ID NO: 89 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (12)..(12): Norleucine
  C-term NH2
FAAYWEALAAALA

SEQ ID NO: 90 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (13)..(13): D-amino acid
  C-term NH2
FAAYWEALAAAIA

SEQ ID NO: 91 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (13)..(13): D-amino acid
  C-term NH2
FAAYWEALAAAMA

SEQ ID NO: 92 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (12)..(12): Norleucine
  MOD_RES (13)..(13): D-amino acid
  C-term NH2
FAAYWEALAAALA

SEQ ID NO: 93 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (13)..(13): D-amino acid
  C-term NH2
FAAYWEALAAAIV

SEQ ID NO: 94 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (13)..(13): D-amino acid
  C-term NH2
FAAYWEALAAAMV

SEQ ID NO: 95 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (12)..(12): Norleucine
  MOD_RES (13)..(13): D-amino acid
  C-term NH2
FAAYWEALAAALV

SEQ ID NO: 96 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (13)..(13): D-amino acid
  C-term NH2
FAAYWEALAAAIL

SEQ ID NO: 97 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (13)..(13): D-amino acid
  C-term NH2
FAAYWEALAAAML

SEQ ID NO: 98 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (12)..(12): Norleucine
  MOD_RES (13)..(13): D-amino acid
  C-term NH2
FAAYWEALAAALL

SEQ ID NO: 99 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (12)..(12): Norleucine
  MOD_RES (13)..(13): D-amino acid
  C-term NH2
FAAYWEALAAALL

SEQ ID NO: 100 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASAA

SEQ ID NO: 101 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASAA

SEQ ID NO: 102 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
WTFAFYWSQLAAVAA

SEQ ID NO: 103 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
WTFAFYWSQLAAVAA

SEQ ID NO: 104 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
WTFAVYWSQLAAVA

SEQ ID NO: 105 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
WTFAVYWSQLAAVA

SEQ ID NO: 106 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
WTFAFYWSQLASAAA

SEQ ID NO: 107 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
WTFAFYWSQLASAAA

SEQ ID NO: 108 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(16): D-amino acid
  C-term NH2
WTFAVYWSQLAAVAAA

SEQ ID NO: 109 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(16): D-amino acid
  C-term NH2
WTFAVYWSQLAAVAAA

SEQ ID NO: 110 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLAAVG

SEQ ID NO: 111 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLAAVG

SEQ ID NO: 112 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLAAVQ

SEQ ID NO: 113 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLAAVQ

SEQ ID NO: 114 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): D-amino acid
  C-term NH2
LTFAAYWAQLASAA

SEQ ID NO: 115 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): D-amino acid
  C-term NH2
LTFAAYWAQLASAA

SEQ ID NO: 116 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASAA

SEQ ID NO: 117 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASAA

SEQ ID NO: 118 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Amino acid comprising two pentenyl-alanine olefin side chains, each of which is crosslinked to another amino acid as indicated
  misc_feature (11)..(14): Crosslink between residues
  MOD_RES (14)..(14): Alpha-Me alkyne 1,4 triazole (5 carbon) alanine olefin amino acid connected by an all-carbon crosslinker comprising one double bond
  C-term NH2
LTFAAYWEQLASAA

SEQ ID NO: 119 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASLA

SEQ ID NO: 120 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASLA

SEQ ID NO: 121 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASWA

SEQ ID NO: 122 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASWA

SEQ ID NO: 123 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASVS

SEQ ID NO: 124 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASAS

SEQ ID NO: 125 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASVG

SEQ ID NO: 126 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): D-amino acid
  C-term NH2
ETFAVYWAQLASAA

SEQ ID NO: 127 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ETFAVYWAQLASAA

SEQ ID NO: 128 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ETFAVYWAQLASVA

SEQ ID NO: 129 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ETFAVYWAQLASLA

SEQ ID NO: 130 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ETFAVYWAQLASWA

SEQ ID NO: 131 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ETFAKYWAQLASWA

SEQ ID NO: 132 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ETFAVYWAQLASVS

SEQ ID NO: 133 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ETFAVYWAQLASAS

SEQ ID NO: 134 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ETFAVYWAQLASVG

SEQ ID NO: 135 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): D-amino acid
  C-term NH2
LTFAVYWAQLASSA

SEQ ID NO: 136 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): D-amino acid
  C-term NH2
ETFAVYWAQLASSA

SEQ ID NO: 137 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): D-amino acid
  C-term NH2
LTFAVYWAQLASNA

SEQ ID NO: 138 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): D-amino acid
  C-term NH2
ETFAVYWAQLASNA

SEQ ID NO: 139 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): D-amino acid
  C-term NH2
LTFAVYWAQLASAA

SEQ ID NO: 140 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAVYWAQLASVA

SEQ ID NO: 141 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAVYWAQLASVA

SEQ ID NO: 142 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAVYWAQLASWA

SEQ ID NO: 143 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAVYWAQLASVS

SEQ ID NO: 144 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAVYWAQLASVS

SEQ ID NO: 145 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAVYWAQLASAS

SEQ ID NO: 146 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAVYWAQLASAS

SEQ ID NO: 147 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAVYWAQLASVG

SEQ ID NO: 148 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAVYWAQLASVG

SEQ ID NO: 149 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAA

SEQ ID NO: 150 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAA

SEQ ID NO: 151 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclopentyl-Gly
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQGASAA

SEQ ID NO: 152 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclopentyl-Gly
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQGASAA

SEQ ID NO: 153 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQFASAA

SEQ ID NO: 154 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQFASAA

SEQ ID NO: 155 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAA

SEQ ID NO: 156 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAA

SEQ ID NO: 157 - protein, 14 aa, Artificial Sequence
  Description of Artificial Sequence: Synthetic peptide
  N-term Ac
  MOD_RES (3)..(3): 3-chloro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQLASAA

SEQ ID NO: 158 - protein, 14 aa, Artificial Sequence
  Description of Artificial Sequence: Synthetic peptide
  N-term Ac
  MOD_RES (3)..(3): 3-chloro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQLASAA

SEQ ID NO: 159 - protein, 14 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQLASAA

SEQ ID NO: 160 - protein, 14 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQLASAA

SEQ ID NO: 161 - protein, 14 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQLASAA

SEQ ID NO: 162 - protein, 14 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQLASAA

SEQ ID NO: 163 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ETFAEYWAQLASAA

SEQ ID NO: 164 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWVQLASAA

SEQ ID NO: 165 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAHWAQLASAA

SEQ ID NO: 166 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAEWAQLASAA

SEQ ID NO: 167 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAASWAQLASAA

SEQ ID NO: 168 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAEWAQLASAA

SEQ ID NO: 169 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAASWAQLASAA

SEQ ID NO: 170 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (11)..(11): Alpha-Me alkyne 1,4 triazole (5 carbon) alanine olefin amino acid connected by an all-carbon crosslinker comprising one double bond
  C-term NH2
LTFAAFWAQLASAA

SEQ ID NO: 171 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (11)..(11): Alpha-Me alkyne 1,4 triazole (5 carbon) alanine olefin amino acid connected by an all-carbon crosslinker comprising one double bond
  C-term NH2
LTFAAFWAQLASAA

SEQ ID NO: 172 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAHWAQLAAAIA

SEQ ID NO: 173 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
ITFAFYWAQLAAAIA

SEQ ID NO: 174 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
ITFAEHWAQLAAAIA

SEQ ID NO: 175 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
ITFAEHWAQLAAAIA

SEQ ID NO: 176 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
ETFAEHWAQLAAAIA

SEQ ID NO: 177 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
ETFAEHWAQLAAAIA

SEQ ID NO: 178 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAHWVQLAAAIA

SEQ ID NO: 179 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
ITFAFYWVQLAAAIA

SEQ ID NO: 180 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
ITFAEYWVQLAAAIA

SEQ ID NO: 181 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
ITFAEHWVQLAAAIA

SEQ ID NO: 182 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAEWAQLAAAIA

SEQ ID NO: 183 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAFWAQLAAAIA

SEQ ID NO: 184 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAFWAQLAAAIA

SEQ ID NO: 185 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAHWAQLAAHFA

SEQ ID NO: 186 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ITFAFYWAQLAAHFA

SEQ ID NO: 187 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ITFAFYWAQLAAHFA

SEQ ID NO: 188 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ITFAFHWAQLAAEFA

SEQ ID NO: 189 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ITFAFHWAQLAAEFA

SEQ ID NO: 190 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ITFAEHWAQLAAHFA

SEQ ID NO: 191 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ITFAEHWAQLAAHFA

SEQ ID NO: 192 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAHWVQLAAHFA

SEQ ID NO: 193 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ITFAFYWVQLAAHFA

SEQ ID NO: 194 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ITFAEYWVQLAAHFA

SEQ ID NO: 195 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ITFAEHWVQLAAHFA

SEQ ID NO: 196 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ITFAEHWVQLAAHFA

SEQ ID NO: 197 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ETFAEYWAALASAA

SEQ ID NO: 198 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWVALASAA

SEQ ID NO: 199 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAHWAALASAA

SEQ ID NO: 200 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAEWAALASAA

SEQ ID NO: 201 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAEWAALASAA

SEQ ID NO: 202 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAASWAALASAA

SEQ ID NO: 203 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAASWAALASAA

SEQ ID NO: 204 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAALAAAIA

SEQ ID NO: 205 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAALAAAIA

SEQ ID NO: 206 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAALAAHFA

SEQ ID NO: 207 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEHWAQLAAHIA

SEQ ID NO: 208 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEHWAQLAAHIA

SEQ ID NO: 209 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAHWAQLAAHIA

SEQ ID NO: 210 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEYWAQLAAHIA

SEQ ID NO: 211 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAAAFA

SEQ ID NO: 212 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAAAFA

SEQ ID NO: 213 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAAAWA

SEQ ID NO: 214 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAAAVA

SEQ ID NO: 215 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAAAVA

SEQ ID NO: 216 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAAALA

SEQ ID NO: 217 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAAALA

SEQ ID NO: 218 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEYWAQLAAAIA

SEQ ID NO: 219 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEYWAQLAAAIA

SEQ ID NO: 220 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEYWAQLAAAFA

SEQ ID NO: 221 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEYWAQLAAAFA

SEQ ID NO: 222 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEYWAQLAAAVA

SEQ ID NO: 223 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEYWAQLAAAVA

SEQ ID NO: 224 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEHWAQLAAAIA

SEQ ID NO: 225 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEHWAQLAAAIA

SEQ ID NO: 226 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEHWAQLAAAWA

SEQ ID NO: 227 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEHWAQLAAAWA

SEQ ID NO: 228 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEHWAQLAAALA

SEQ ID NO: 229 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEHWAQLAAALA

SEQ ID NO: 230 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
ETFAEHWVQLAAALA

SEQ ID NO: 231 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAAAAA

SEQ ID NO: 232 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAAAAA

SEQ ID NO: 233 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): 2-aminoisobutyric acid
  C-term NH2
LTFAAYWAQLAAAXA

SEQ ID NO: 234 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): 2-aminoisobutyric acid
  C-term NH2
LTFAAYWAQLAAAXA

SEQ ID NO: 235 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (16)..(16): D-amino acid
  C-term NH2
LTFAAYWAQLAAAAAA

SEQ ID NO: 236 - protein, 15 aa, Artificial Sequence
  Description of Artificial Sequence: Synthetic peptide
  N-term Ac
  MOD_RES (4)..(4): Alpha-Me R5-pentenyl-alanine olefin amino acids connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bonds8
  MOD_RES (15)..(15): D-amino acid
  C-term NH2
LTFAAYWAQLAAAIA

SEQ ID NO: 237 - protein, 14 aa, Artificial Sequence
  Description of Artificial Sequence: Synthetic peptide
  N-term Ac
  MOD_RES (4)..(4): Alpha-Me R5-pentenyl-alanine olefin amino acids connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bonds8
  C-term NH2
LTFAAYWAQLASAA

SEQ ID NO: 238 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQAAAALA

SEQ ID NO: 239 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
ETFAAYWAQAAAALA

SEQ ID NO: 240 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAEYWAQAAAALA

SEQ ID NO: 241 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQAAAWLA

SEQ ID NO: 242 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
ETFAAYWAQAAAWLA

SEQ ID NO: 243 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAEYWAQAAAWLA

SEQ ID NO: 244 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAFA

SEQ ID NO: 245 - protein, 15 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAEYWAQAASALA

SEQ ID NO: 246 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAEFWAQAASALA

SEQ ID NO: 247 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAEYWSQAASALA

SEQ ID NO: 248 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAEYWWQAASALA

SEQ ID NO: 249 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEYWAQAAAAIA

SEQ ID NO: 250 - protein, 15 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEYWAQAAAAIA

SEQ ID NO: 251 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEFWAQAAAAIA

SEQ ID NO: 252 - protein, 14 aa, Artificial Sequence
  Description of Artificial Sequence: Synthetic peptide
  N-term Pam
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
ETFAEYWAQAASAA

SEQ ID NO: 253 - protein, 14 aa, Artificial Sequence
  Description of Artificial Sequence: Synthetic peptide
  N-term Ac
  MOD_RES (3)..(3): homo-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEFWAQAASAA

SEQ ID NO: 254 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTAAEYWAQAASAA

SEQ ID NO: 255 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYAAQAASAA

SEQ ID NO: 256 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (7)..(7): 2Nal
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYAAQAASAA

SEQ ID NO: 257 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQAASAA

SEQ ID NO: 258 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAF

SEQ ID NO: 259 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEYWAQAASAFA

SEQ ID NO: 260 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQAASAF

SEQ ID NO: 261 - protein, 14 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQAASAF

SEQ ID NO: 262 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAAFWAQAASAF

SEQ ID NO: 263 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (7)..(7): 6cl-Trp
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAF

SEQ ID NO: 264 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAAYWSQAASAF

SEQ ID NO: 265 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAAYWWQAASAF

SEQ ID NO: 266 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQAAAAIA

SEQ ID NO: 267 - protein, 15 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQAAAAIA

SEQ ID NO: 268 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (7)..(7): 6cl-Trp
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQAAAAIA

SEQ ID NO: 269 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAFWAQAAAAIA

SEQ ID NO: 270 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEYWAQAAAAFA

SEQ ID NO: 271 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEYWAQAAAAFA

SEQ ID NO: 272 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): D-amino acid
  C-term NH2
ETFAAYWAQAAAWLA

SEQ ID NO: 273 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): D-amino acid
  C-term NH2
LTFAEYWAQAAAWLA

SEQ ID NO: 274 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): D-amino acid
  C-term NH2
ETFAEYWAQAAAWLA

SEQ ID NO: 275 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): D-amino acid
  C-term NH2
ETFAEYWAQAAAWLA

SEQ ID NO: 276 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQAASAFA

SEQ ID NO: 277 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQAASAFA

SEQ ID NO: 278 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): D-amino acid
  C-term NH2
ETFAAYWAQLAAWLA

SEQ ID NO: 279 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): D-amino acid
  C-term NH2
LTFAEYWAQLAAWLA

SEQ ID NO: 280 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): D-amino acid
  C-term NH2
ETFAEYWAQLAAWLA

SEQ ID NO: 281 - protein, 14 aa, Artificial Sequence
  Description of Artificial Sequence: Synthetic peptide
  N-term Dmaac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQLASAA

SEQ ID NO: 282 - protein, 14 aa, Artificial Sequence
  Description of Artificial Sequence: Synthetic peptide
  N-term Hexac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQLASAA

SEQ ID NO: 283 - protein, 14 aa, Artificial Sequence
  Description of Artificial Sequence: Synthetic peptide
  N-term Napac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQLASAA

SEQ ID NO: 284 - protein, 14 aa, Artificial Sequence
  Description of Artificial Sequence: Synthetic peptide
  N-term Decac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQLASAA

SEQ ID NO: 285 - protein, 14 aa, Artificial Sequence
  Description of Artificial Sequence: Synthetic peptide
  N-term Admac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQLASAA

SEQ ID NO: 286 - protein, 14 aa, Artificial Sequence
  Description of Artificial Sequence: Synthetic peptide
  N-term Tmac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQLASAA

SEQ ID NO: 287 - protein, 14 aa, Artificial Sequence
  Description of Artificial Sequence: Synthetic peptide
  N-term Pam
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQLASAA

SEQ ID NO: 288 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQAAAALA

SEQ ID NO: 289 - protein, 15 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEYWAQAAAAIA

SEQ ID NO: 290 - protein, 14 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAA

SEQ ID NO: 291 - protein, 14 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAA

SEQ ID NO: 292 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEFWAQAASAA

SEQ ID NO: 293 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEFWAQAASAA

SEQ ID NO: 294 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWSQAASAA

SEQ ID NO: 295 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWSQAASAA

SEQ ID NO: 296 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQLASAA

SEQ ID NO: 297 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASAF

SEQ ID NO: 298 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASAF

SEQ ID NO: 299 - protein, 14 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASAA

SEQ ID NO: 300 - protein, 14 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASAA

SEQ ID NO: 301 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAAFWAQLASAA

SEQ ID NO: 302 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAAFWAQLASAA

SEQ ID NO: 303 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAAYWSQLASAA

SEQ ID NO: 304 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAAYWSQLASAA

SEQ ID NO: 305 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAEYWAQLAAALA

SEQ ID NO: 306 - protein, 15 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLAAALA

SEQ ID NO: 307 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAFWAQLAAALA

SEQ ID NO: 308 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWSQLAAALA

SEQ ID NO: 309 - protein, 15 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLAAALA

SEQ ID NO: 310 - protein, 15 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLAAALA

SEQ ID NO: 311 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAFWAQLAAALA

SEQ ID NO: 312 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAFWAQLAAALA

SEQ ID NO: 313 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWSQLAAALA

SEQ ID NO: 314 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWSQLAAALA

SEQ ID NO: 315 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  MOD_RES (16)..(16): D-amino acid
  C-term NH2
LTFAAYWAQLAAAAAA

SEQ ID NO: 316 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  MOD_RES (16)..(16): D-amino acid
  C-term NH2
LTFAAYWAQLAAAAAA

SEQ ID NO: 317 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAAYWAQLAAAAAAA

SEQ ID NO: 318 - protein, 18 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (18)..(18): D-amino acid
  C-term NH2
LTFAAYWAQLAAAAAAAA

SEQ ID NO: 319 - protein, 18 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (18)..(18): D-amino acid
  C-term NH2
LTFAAYWAQLAAAAAAAA

SEQ ID NO: 320 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAEYWAQLAAALA

SEQ ID NO: 321 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  MOD_RES (15)..(15): Norleucine
  C-term NH2
AATFAAYWAQLAAALA

SEQ ID NO: 322 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLAAALAA

SEQ ID NO: 323 - protein, 17 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  MOD_RES (15)..(15): Norleucine
  C-term NH2
ALTFAAYWAQLAAALAA

SEQ ID NO: 324 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQAAAALAA

SEQ ID NO: 325 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLAAALAA

SEQ ID NO: 326 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAAA

SEQ ID NO: 327 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAAA

SEQ ID NO: 328 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAAAA

SEQ ID NO: 329 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAAAA

SEQ ID NO: 330 - protein, 15 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me alkyne 1,4 triazole (5 carbon) alanine olefin amino acid connected by an all-carbon crosslinker comprising one double bond
  C-term NH2
ALTFAEYWAQAASAA

SEQ ID NO: 331 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me alkyne 1,4 triazole (5 carbon) alanine olefin amino acid connected by an all-carbon crosslinker comprising one double bond
  C-term NH2
ALTFAEYWAQAASAAA

SEQ ID NO: 332 - protein, 15 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me alkyne 1,4 triazole (5 carbon) alanine olefin amino acid connected by an all-carbon crosslinker comprising one double bond
  C-term NH2
ALTFAEYWAQAASAA

SEQ ID NO: 333 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAEYWAQLAAAAAAA

SEQ ID NO: 334 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (7)..(7): 6cl-Trp
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAA

SEQ ID NO: 335 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (7)..(7): 6cl-Trp
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAEFWAQAASALA

SEQ ID NO: 336 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (7)..(7): 6cl-Trp
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAEFWAQAASALA

SEQ ID NO: 337 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (7)..(7): 6cl-Trp
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEFWAQAAAAIA

SEQ ID NO: 338 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (7)..(7): 6cl-Trp
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEFWAQAAAAIA

SEQ ID NO: 339 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAAYWAQLAAAAAAA

SEQ ID NO: 340 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAAYWAQLAAAAAAA

SEQ ID NO: 341 - protein, 16 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (5)..(5): 6cl-Trp
  MOD_RES (9)..(9): Alpha-Me alkyne 1,4 triazole (5 carbon) alanine olefin amino acid connected by an all-carbon crosslinker comprising one double bond
  MOD_RES (16)..(16): D-amino acid
  C-term NH2
FAAYWEALAAAAAAAA

SEQ ID NO: 342 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
ETFAEYWAQLAAAAAAA

SEQ ID NO: 343 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
ETFAEYWAQLAAAAAAA

SEQ ID NO: 344 - protein, 18 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (18)..(18): D-amino acid
  C-term NH2
LTFAEYWAQLAAAAAAAA

SEQ ID NO: 345 - protein, 18 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (18)..(18): D-amino acid
  C-term NH2
LTFAEYWAQLAAAAAAAA

SEQ ID NO: 346 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (17)..(17): D-amino acid
  C-term NH2
LTFAAYWAQLAAALAAA

SEQ ID NO: 347 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (17)..(17): D-amino acid
  C-term NH2
LTFAAYWAQLAAALAAA

SEQ ID NO: 348 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAEYWAQAAAAAAAA

SEQ ID NO: 349 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAEYWAQAAAAAAAA

SEQ ID NO: 350 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAEFWAQAAAAAAAA

SEQ ID NO: 351 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAEFWAQAAAAAAAA

SEQ ID NO: 352 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAEYWSQAAAAAAAA

SEQ ID NO: 353 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAEYWSQAAAAAAAA

SEQ ID NO: 354 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEYWAQAASAAA

SEQ ID NO: 355 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEYWAQAASAAA

SEQ ID NO: 356 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me alkyne 1,4 triazole (5 carbon) alanine olefin amino acid connected by an all-carbon crosslinker comprising one double bond
  MOD_RES (16)..(16): D-amino acid
  C-term NH2
ALTFAEYWAQAASAAA

SEQ ID NO: 357 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me alkyne 1,4 triazole (5 carbon) alanine olefin amino acid connected by an all-carbon crosslinker comprising one double bond
  MOD_RES (16)..(16): D-amino acid
  C-term NH2
ALTFAEYWAQAASAAA

SEQ ID NO: 358 - protein, 17 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me alkyne 1,4 triazole (5 carbon) alanine olefin amino acid connected by an all-carbon crosslinker comprising one double bond
  MOD_RES (17)..(17): D-amino acid
  C-term NH2
ALTFAEYWAQAASAAAA

SEQ ID NO: 359 - protein, 17 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me alkyne 1,4 triazole (5 carbon) alanine olefin amino acid connected by an all-carbon crosslinker comprising one double bond
  MOD_RES (17)..(17): D-amino acid
  C-term NH2
ALTFAEYWAQAASAAAA

SEQ ID NO: 360 - protein, 18 aa, Artificial Sequence
  Description of Artificial Sequence: Synthetic peptide
  N-term Ac
  MOD_RES (6)..(6): Alpha-Me R-azide 1,4 triazole (6 carbon) alanine olefin amino acid connected by an all-carbon crosslinker comprising one double bond
  misc_feature (6)..(13): Crosslink between residues
  MOD_RES (12)..(12): Cyclobutyl-Ala
  MOD_RES (13)..(13): Alpha-Me alkyne 1,4 triazole (5 carbon) alanine olefin amino acid connected by an all-carbon crosslinker comprising one double bond
  MOD_RES (18)..(18): D-amino acid
  C-term NH2
AALTFAEYWAQAASAAAA

SEQ ID NO: 361 - protein, 18 aa, Artificial Sequence
  Description of Artificial Sequence: Synthetic peptide
  N-term Ac
  MOD_RES (6)..(6): Alpha-Me R-azide 1,4 triazole (6 carbon) alanine olefin amino acid connected by an all-carbon crosslinker comprising one double bond
  misc_feature (6)..(13): Crosslink between residues
  MOD_RES (12)..(12): Cyclobutyl-Ala
  MOD_RES (13)..(13): Alpha-Me alkyne 1,4 triazole (5 carbon) alanine olefin amino acid connected by an all-carbon crosslinker comprising one double bond
  MOD_RES (18)..(18): D-amino acid
  C-term NH2
AALTFAEYWAQAASAAAA

SEQ ID NO: 362 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
RTFAEYWAQAASAA

SEQ ID NO: 363 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LRFAEYWAQAASAA

SEQ ID NO: 364 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWRQAASAA

SEQ ID NO: 365 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWARAASAA

SEQ ID NO: 366 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAARAA

SEQ ID NO: 367 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASRA

SEQ ID NO: 368 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAR

SEQ ID NO: 369 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me alkyne 1,4 triazole (5 carbon) alanine olefin amino acid connected by an all-carbon crosslinker comprising one double bond
  C-term NH2
ALTFAEYWAQAASAA

SEQ ID NO: 370 - protein, 16 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  MOD_RES (15)..(15): Norleucine
  C-term NH2
ALTFAAYWAQLAAALA

SEQ ID NO: 371 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LAFAEYWAQLAAALA

SEQ ID NO: 372 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
ATFAEYWAQLAAALA

SEQ ID NO: 373 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
AAFAEYWAQLAAALA

SEQ ID NO: 374 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  MOD_RES (15)..(15): Norleucine
  C-term NH2
AAAFAEYWAQLAAALA

SEQ ID NO: 375 - protein, 17 aa, Artificial Sequence
  Description of Artificial Sequence: Synthetic peptide
  N-term Ac
  MOD_RES (6)..(6): Alpha-Me R-azide 1,4 triazole (6 carbon) alanine olefin amino acid connected by an all-carbon crosslinker comprising one double bond
  misc_feature (6)..(13): Crosslink between residues
  MOD_RES (13)..(13): Alpha-Me alkyne 1,4 triazole (5 carbon) alanine olefin amino acid connected by an all-carbon crosslinker comprising one double bond
  MOD_RES (16)..(16): Norleucine
  C-term NH2
AAAAFAEYWAQLAAALA

SEQ ID NO: 376 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  MOD_RES (15)..(15): Norleucine
  C-term NH2
AATFAEYWAQLAAALA

SEQ ID NO: 377 - protein, 17 aa, Artificial Sequence
  Description of Artificial Sequence: Synthetic peptide
  N-term Ac
  MOD_RES (6)..(6): Alpha-Me R-azide 1,4 triazole (6 carbon) alanine olefin amino acid connected by an all-carbon crosslinker comprising one double bond
  misc_feature (6)..(13): Crosslink between residues
  MOD_RES (13)..(13): Alpha-Me alkyne 1,4 triazole (5 carbon) alanine olefin amino acid connected by an all-carbon crosslinker comprising one double bond
  MOD_RES (16)..(16): Norleucine
  C-term NH2
AALTFAEYWAQLAAALA

SEQ ID NO: 378 - protein, 18 aa, Artificial Sequence
  Description of Artificial Sequence: Synthetic peptide
  N-term Ac
  MOD_RES (7)..(7): Alpha-Me R-azide 1,4 triazole (6 carbon) alanine olefin amino acid connected by an all-carbon crosslinker comprising one double bond
  misc_feature (7)..(14): Crosslink between residues
  MOD_RES (14)..(14): Alpha-Me alkyne 1,4 triazole (5 carbon) alanine olefin amino acid connected by an all-carbon crosslinker comprising one double bond
  MOD_RES (18)..(18): Norleucine
  C-term NH2
AAALTFAEYWAQLAAALA

SEQ ID NO: 379 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAEYWAQLAAALAA

SEQ ID NO: 380 - protein, 17 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  MOD_RES (15)..(15): Norleucine
  C-term NH2
ALTFAEYWAQLAAALAA

SEQ ID NO: 381 - protein, 18 aa, Artificial Sequence
  Description of Artificial Sequence: Synthetic peptide
  N-term Ac
  MOD_RES (6)..(6): Alpha-Me R-azide 1,4 triazole (6 carbon) alanine olefin amino acid connected by an all-carbon crosslinker comprising one double bond
  misc_feature (6)..(13): Crosslink between residues
  MOD_RES (13)..(13): Alpha-Me alkyne 1,4 triazole (5 carbon) alanine olefin amino acid connected by an all-carbon crosslinker comprising one double bond
  MOD_RES (16)..(16): Norleucine
  C-term NH2
AALTFAEYWAQLAAALAA

SEQ ID NO: 382 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAEYWAQAAAALAA

SEQ ID NO: 383 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAEYWAQLAAALAA

SEQ ID NO: 384 - protein, 17 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (11)..(11): homo-Leu
  MOD_RES (12)..(12): Alpha-Me alkyne 1,4 triazole (5 carbon) alanine olefin amino acid connected by an all-carbon crosslinker comprising one double bond
  MOD_RES (15)..(15): Norleucine
  C-term NH2
ALTFAEYWAQLAAALAA

SEQ ID NO: 385 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): N-methyl-Tyr
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLAAALA

SEQ ID NO: 386 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): N-methyl-Tyr
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLAAALA

SEQ ID NO: 387 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (7)..(7): N-methyl-Trp
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLAAALA

SEQ ID NO: 388 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (7)..(7): N-methyl-Trp
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLAAALA

SEQ ID NO: 389 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (7)..(7): Alpha-Me-Trp
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLAAALA

SEQ ID NO: 390 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (7)..(7): Alpha-Me-Trp
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLAAALA

SEQ ID NO: 391 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (8)..(8): 2-aminoisobutyric acid
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWXQLAAALA

SEQ ID NO: 392 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (8)..(8): 2-aminoisobutyric acid
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWXQLAAALA

SEQ ID NO: 393 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (13)..(13): 2-aminoisobutyric acid
  MOD_RES (14)..(14): Norleucine
  C-term NH2
LTFAAYWAQLAAXLA

SEQ ID NO: 394 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (13)..(13): 2-aminoisobutyric acid
  MOD_RES (14)..(14): Norleucine
  C-term NH2
LTFAAYWAQLAAXLA

SEQ ID NO: 395 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (13)..(13): D-amino acid
  MOD_RES (14)..(14): Norleucine
  C-term NH2
LTFAAYWAQLAAALA

SEQ ID NO: 396 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (13)..(13): D-amino acid
  MOD_RES (14)..(14): Norleucine
  C-term NH2
LTFAAYWAQLAAALA

SEQ ID NO: 397 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (13)..(13): Sarcosine
  MOD_RES (14)..(14): Norleucine
  C-term NH2
LTFAAYWAQLAAXLA

SEQ ID NO: 398 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (13)..(13): Sarcosine
  MOD_RES (14)..(14): Norleucine
  C-term NH2
LTFAAYWAQLAAXLA

SEQ ID NO: 399 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): 2-aminoisobutyric acid
  C-term NH2
LTFAAYWAQLAAALX

SEQ ID NO: 400 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): 2-aminoisobutyric acid
  C-term NH2
LTFAAYWAQLAAALX

SEQ ID NO: 401 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): N-methyl-Ala
  C-term NH2
LTFAAYWAQLAAALA

SEQ ID NO: 402 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): N-methyl-Ala
  C-term NH2
LTFAAYWAQLAAALA

SEQ ID NO: 403 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): Sarcosine
  C-term NH2
LTFAAYWAQLAAALX

SEQ ID NO: 404 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): Sarcosine
  C-term NH2
LTFAAYWAQLAAALX

SEQ ID NO: 405 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (16)..(16): 2-aminoisobutyric acid
  C-term NH2
LTFAAYWAQLAAALAX

SEQ ID NO: 406 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (16)..(16): 2-aminoisobutyric acid
  C-term NH2
LTFAAYWAQLAAALAX

SEQ ID NO: 407 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (16)..(16): N-methyl-Ala
  C-term NH2
LTFAAYWAQLAAALAA

SEQ ID NO: 408 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (16)..(16): N-methyl-Ala
  C-term NH2
LTFAAYWAQLAAALAA

SEQ ID NO: 409 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (16)..(16): D-amino acid
  C-term NH2
LTFAAYWAQLAAALAA

SEQ ID NO: 410 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (16)..(16): D-amino acid
  C-term NH2
LTFAAYWAQLAAALAA

SEQ ID NO: 411 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (16)..(16): Sarcosine
  C-term NH2
LTFAAYWAQLAAALAX

SEQ ID NO: 412 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (16)..(16): Sarcosine
  C-term NH2
LTFAAYWAQLAAALAX

SEQ ID NO: 413 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (5)..(5): Cou4
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAXYWAQLAAALA

SEQ ID NO: 414 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (5)..(5): Cou4
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAXYWAQLAAALA

SEQ ID NO: 415 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (8)..(8): Cou4
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWXQLAAALA

SEQ ID NO: 416 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (12)..(12): Cou4
  MOD_RES (14)..(14): Norleucine
  C-term NH2
LTFAAYWAQLAXALA

SEQ ID NO: 417 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (12)..(12): Cou4
  MOD_RES (14)..(14): Norleucine
  C-term NH2
LTFAAYWAQLAXALA

SEQ ID NO: 418 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (13)..(13): Cou4
  MOD_RES (14)..(14): Norleucine
  C-term NH2
LTFAAYWAQLAAXLA

SEQ ID NO: 419 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (13)..(13): Cou4
  MOD_RES (14)..(14): Norleucine
  C-term NH2
LTFAAYWAQLAAXLA

SEQ ID NO: 420 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term OH
LTFAAYWAQLAAALA

SEQ ID NO: 421 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term OH
LTFAAYWAQLAAALA

SEQ ID NO: 422 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NHnPr
LTFAAYWAQLAAALA

SEQ ID NO: 423 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NHnPr
LTFAAYWAQLAAALA

SEQ ID NO: 424 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NHnBu33Me
LTFAAYWAQLAAALA

SEQ ID NO: 425 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NHnBu33Me
LTFAAYWAQLAAALA

SEQ ID NO: 426 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NHHex
LTFAAYWAQLAAALA

SEQ ID NO: 427 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  N-term NHHex
LTFAAYWAQLAAALA

SEQ ID NO: 428 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTAAAYWAQLAAALA

SEQ ID NO: 429 - protein, 15 aa, Artificial Sequence
  Description of Artificial Sequence: Synthetic peptide
  N-term Ac
  MOD_RES (3)..(3): homo-Leu
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTLAAYWAQLAAALA

SEQ ID NO: 430 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYAAQLAAALA

SEQ ID NO: 431 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (7)..(7): 2Nal
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYAAQLAAALA

SEQ ID NO: 432 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (8)..(8): Cou4
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWXQAASAA

SEQ ID NO: 433 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (8)..(8): Cou7
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWXQAASAA

SEQ ID NO: 434 - protein, 14 aa, Artificial Sequence
  Description of Artificial Sequence: Synthetic peptide
  N-term Dmaac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAA

SEQ ID NO: 435 - protein, 17 aa, Artificial Sequence
  Description of Artificial Sequence: Synthetic peptide
  N-term Dmaac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAAYWAQLAAAAAAA

SEQ ID NO: 436 - protein, 17 aa, Artificial Sequence
  Description of Artificial Sequence: Synthetic peptide
  N-term Dmaac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAAYWAQLAAAAAAA

SEQ ID NO: 437 - protein, 17 aa, Artificial Sequence
  Description of Artificial Sequence: Synthetic peptide
  N-term Dmaac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAEYWAQLAAAAAAA

SEQ ID NO: 438 - protein, 17 aa, Artificial Sequence
  Description of Artificial Sequence: Synthetic peptide
  N-term Dmaac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAEYWAQLAAAAAAA

SEQ ID NO: 439 - protein, 15 aa, Artificial Sequence
  Description of Artificial Sequence: Synthetic peptide
  N-term Dmaac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEFWAQAAAAIA

SEQ ID NO: 440 - protein, 15 aa, Artificial Sequence
  Description of Artificial Sequence: Synthetic peptide
  N-term Dmaac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEFWAQAAAAIA

SEQ ID NO: 441 - protein, 15 aa, Artificial Sequence
  Description of Artificial Sequence: Synthetic peptide
  N-term Dmaac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLAAALA

SEQ ID NO: 442 - protein, 15 aa, Artificial Sequence
  Description of Artificial Sequence: Synthetic peptide
  N-term Dmaac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLAAALA

SEQ ID NO: 443 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLAAALA

SEQ ID NO: 444 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAEYWAQLAAAAAAA

SEQ ID NO: 445 - protein, 16 aa, Artificial Sequence
  Description of Artificial Sequence: Synthetic peptide
  MOD_RES (1)..(1): Cou6
  MOD_RES (2)..(2): Beta-Ala
  MOD_RES (6)..(6): Alpha-Me R-azide 1,4 triazole (6 carbon) alanine olefin amino acid connected by an all-carbon crosslinker comprising one double bond
  misc_feature (6)..(13): Crosslink between residues
  MOD_RES (12)..(12): homo-Leu
  MOD_RES (13)..(13): Alpha-Me alkyne 1,4 triazole (5 carbon) alanine olefin amino acid connected by an all-carbon crosslinker comprising one double bond
  C-term NH2
XALTFAEYWAQLASAA

SEQ ID NO: 446 - protein, 16 aa, Artificial Sequence
  Description of Artificial Sequence: Synthetic peptide
  MOD_RES (1)..(1): Cou8
  MOD_RES (2)..(2): Beta-Ala
  MOD_RES (6)..(6): Alpha-Me R-azide 1,4 triazole (6 carbon) alanine olefin amino acid connected by an all-carbon crosslinker comprising one double bond
  misc_feature (6)..(13): Crosslink between residues
  MOD_RES (12)..(12): homo-Leu
  MOD_RES (13)..(13): Alpha-Me alkyne 1,4 triazole (5 carbon) alanine olefin amino acid connected by an all-carbon crosslinker comprising one double bond
  C-term NH2
XALTFAEYWAQLASAA

SEQ ID NO: 447 - protein, 17 aa, Artificial Sequence
  Description of Artificial Sequence: Synthetic peptide
  N-term Ac
  MOD_RES (3)..(3): 4-iodo-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAEYWAQLAAAAAAA

SEQ ID NO: 448 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLAAALA

SEQ ID NO: 449 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAAYWAQLAAAAAAA

SEQ ID NO: 450 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAEYWAQLAAAAAAA

SEQ ID NO: 451 - protein, 17 aa, Artificial Sequence
  Description of Artificial Sequence: Synthetic peptide
  N-term Ac
  MOD_RES (4)..(4): Alpha-Me R-azide 1,5 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,5 triazole (5 carbon) alanine olefin amino acid connected by an all-carbon crosslinker comprising one double bond
  MOD_RES (17)..(17): D-amino acid
  C-term NH2
LTFAAYWAQLAAAAAAA

SEQ ID NO: 452 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAA

SEQ ID NO: 453 - protein, 14 aa, Artificial Sequence
  Description of Artificial Sequence: Synthetic peptide
  N-term Ac
  MOD_RES (4)..(4): Alpha-Me R-azide 1,4 triazole (4 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAA

SEQ ID NO: 454 - protein, 14 aa, Artificial Sequence
  Description of Artificial Sequence: Synthetic peptide
  N-term Ac
  MOD_RES (4)..(4): Alpha-Me R-azide 1,4 triazole (5 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAA

SEQ ID NO: 455 - protein, 14 aa, Artificial Sequence
  Description of Artificial Sequence: Synthetic peptide
  N-term Ac
  MOD_RES (4)..(4): Alpha-Me R-azide 1,5 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,5 triazole (5 carbon) alanine olefin amino acid connected by an all-carbon crosslinker comprising one double bond
  C-term NH2
LTFAEYWAQAASAA

SEQ ID NO: 456 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): 5I-Alpha-Me alkyne 1,4 triazole (5 carbon) alanine olefin amino acid connected by an all-carbon crosslinker comprising one double bond
  C-term NH2
LTFAEYWAQAASAA

SEQ ID NO: 457 - protein, 14 aa, Artificial Sequence
  Description of Artificial Sequence: Synthetic peptide
  N-term Ac
  MOD_RES (4)..(4): Alpha-Me R-azide 1,5 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,5 triazole (5 carbon) alanine olefin amino acid connected by an all-carbon crosslinker comprising one double bond
  C-term NH2
LTAAEYWAQAASAA

SEQ ID NO: 458 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTAAEYWAQAASAA

SEQ ID NO: 459 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me alkyne 1,4 triazole (5 carbon) alanine olefin amino acid connected by an all-carbon crosslinker comprising one double bond
  C-term NH2
ALTFAEYWAQAASAA

SEQ ID NO: 460 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me alkyne 1,4 triazole (5 carbon) alanine olefin amino acid connected by an all-carbon crosslinker comprising one double bond
  C-term NH2
ALTAAEYWAQAASAA

SEQ ID NO: 461 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R-azide 1,5 triazole (6 carbon) alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me alkyne 1,5 triazole (5 carbon) alanine olefin amino acid connected by an all-carbon crosslinker comprising one double bond
  C-term NH2
ALTFAEYWAQAASAA

SEQ ID NO: 462 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R-azide 1,5 triazole (6 carbon) alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me alkyne 1,5 triazole (5 carbon) alanine olefin amino acid connected by an all-carbon crosslinker comprising one double bond
  C-term NH2
ALTAAEYWAQAASAA

SEQ ID NO: 463 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): 5Ph-alpha-Me alkyne 1,4 triazole (5 carbon) alanine olefin amino acid connected by an all-carbon crosslinker comprising one double bond
  C-term NH2
LTFAEYWAQAASAA

SEQ ID NO: 464 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): 5Prp-alpha-Me alkyne 1,4 triazole (5 carbon) alanine olefin amino acid connected by an all-carbon crosslinker comprising one double bond
  C-term NH2
LTFAEYWAQAASAA

SEQ ID NO: 465 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAAYWAALAAAAAAA

SEQ ID NO: 466 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): 5penNH2-alpha-Me alkyne 1,4 triazole (5 carbon) alanine olefin amino acid connected by an all-carbon crosslinker comprising one double bond
  C-term NH2
LTFAEYWAQAASAA

SEQ ID NO: 467 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): 5BnzNH2-alpha-Me alkyne 1,4 triazole (5 carbon) alanine olefin amino acid connected by an all-carbon crosslinker comprising one double bond
  C-term NH2
LTFAEYWAQAASAA

SEQ ID NO: 468 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): 5prpOMe-alpha-Me alkyne 1,4 triazole (5 carbon) alanine olefin amino acid connected by an all-carbon crosslinker comprising one double bond
  C-term NH2
LTFAEYWAQAASAA

SEQ ID NO: 469 - protein, 17 aa, Artificial Sequence
  Description of Artificial Sequence: Synthetic peptide
  N-term Ac
  MOD_RES (4)..(4): Alpha-Me R-azide 1,5 triazole (6 carbon) alanine olefin amino acid connected by an all-carbon crosslinker comprising one double bond
  misc_feature (4)..(11): Crosslink between residues
  MOD_RES (11)..(11): 4Me-alpha-Me alkyne 1,5 triazole (5 carbon) alanine olefin amino acid connected by an all-carbon crosslinker comprising one double bond
  MOD_RES (17)..(17): D-amino acid
  C-term NH2
LTFAEYWAQLAAAAAAA

SEQ ID NO: 470 - protein, 17 aa, Artificial Sequence
  Description of Artificial Sequence: Synthetic peptide
  N-term Ac
  MOD_RES (4)..(4): Alpha-Me R-azide 1,5 triazole (6 carbon) alanine olefin amino acid connected by an all-carbon crosslinker comprising one double bond
  misc_feature (4)..(11): Crosslink between residues
  MOD_RES (11)..(11): 4Ph-alpha-Me alkyne 1,5 triazole (5 carbon) alanine olefin amino acid connected by an all-carbon crosslinker comprising one double bond
  MOD_RES (17)..(17): D-amino acid
  C-term NH2
LTFAEYWAQLAAAAAAA

SEQ ID NO: 471 - protein, 14 aa, Artificial Sequence
  Description of Artificial Sequence: Synthetic peptide
  N-term Ac
  MOD_RES (4)..(4): Alpha-Me R-azide 1,5 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): 4Me-alpha-Me alkyne 1,5 triazole (5 carbon) alanine olefin amino acid connected by an all-carbon crosslinker comprising one double bond
  C-term NH2
LTFAEYWAQAASAA

SEQ ID NO: 472 - protein, 14 aa, Artificial Sequence
  Description of Artificial Sequence: Synthetic peptide
  N-term Ac
  MOD_RES (4)..(4): Alpha-Me R-azide 1,5 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): 4Ph-alpha-Me alkyne 1,5 triazole (5 carbon) alanine olefin amino acid connected by an all-carbon crosslinker comprising one double bond
  C-term NH2
LTFAEYWAQAASAA

SEQ ID NO: 473 - protein, 16 aa, Artificial Sequence
  Description of Artificial Sequence: Synthetic peptide
  N-term Ac
  MOD_RES (7)..(7): Alpha-Me R-azide 1,5 triazole (6 carbon) alanine olefin amino acid connected by an all-carbon crosslinker comprising one double bond
  misc_feature (7)..(14): Crosslink between residues
  MOD_RES (14)..(14): Alpha-Me alkyne 1,5 triazole (5 carbon) alanine olefin amino acid connected by an all-carbon crosslinker comprising one double bond
  C-term NH2
QSQQTFANLWRLLAQN

SEQ ID NO: 474 - protein, 16 aa, Artificial Sequence
  Description of Artificial Sequence: Synthetic peptide
  N-term Ac
  MOD_RES (7)..(7): Alpha-Me R-azide 1,4 triazole (5 carbon) alanine olefin amino acid connected by an all-carbon crosslinker comprising one double bond
  misc_feature (7)..(14): Crosslink between residues
  MOD_RES (14)..(14): Alpha-Me alkyne 1,4 triazole (5 carbon) alanine olefin amino acid connected by an all-carbon crosslinker comprising one double bond
  C-term NH2
QSQQTFANLWRLLAQN

SEQ ID NO: 475 - protein, 16 aa, Artificial Sequence
  Description of Artificial Sequence: Synthetic peptide
  N-term Ac
  MOD_RES (7)..(7): Alpha-H R-azide 1,5 triazole (6 carbon) alanine olefin amino acid connected by an all-carbon crosslinker comprising one double bond
  misc_feature (7)..(14): Crosslink between residues
  MOD_RES (14)..(14): Alpha-H alkyne 1,5 triazole (5 carbon) alanine olefin amino acid connected by an all-carbon crosslinker comprising one double bond
  C-term NH2
QSQQTFANLWRLLAQN

SEQ ID NO: 476 - protein, 16 aa, Artificial Sequence
  Description of Artificial Sequence: Synthetic peptide
  N-term Ac
  MOD_RES (7)..(7): Alpha-H R-azide 1,4 triazole (5 carbon) alanine olefin amino acid connected by an all-carbon crosslinker comprising one double bond
  misc_feature (7)..(14): Crosslink between residues
  MOD_RES (14)..(14): Alpha-H alkyne 1,4 triazole (5 carbon) alanine olefin amino acid connected by an all-carbon crosslinker comprising one double bond
  C-term NH2
QSQQTFANLWRLLAQN

SEQ ID NO: 477 - protein, 16 aa, Artificial Sequence
  Description of Artificial Sequence: Synthetic peptide
  N-term Ac
  MOD_RES (7)..(7): Alpha-Me R-azide 1,5 triazole (5 carbon) alanine olefin amino acid connected by an all-carbon crosslinker comprising one double bond
  misc_feature (7)..(14): Crosslink between residues
  MOD_RES (14)..(14): Alpha-Me alkyne 1,5 triazole (5 carbon) alanine olefin amino acid connected by an all-carbon crosslinker comprising one double bond
  C-term NH2
QSQQTFANLWRLLAQN

SEQ ID NO: 478 - protein, 16 aa, Artificial Sequence
  Description of Artificial Sequence: Synthetic peptide
  N-term Ac
  MOD_RES (7)..(7): Alpha-Me R-alkyne 1,5 triazole (5 carbon) alanine olefin amino acid connected by an all-carbon crosslinker comprising one double bond
  misc_feature (7)..(14): Crosslink between residues
  MOD_RES (14)..(14): Alpha-Me azide 1,5 triazole (5 carbon) alanine olefin amino acid connected by an all-carbon crosslinker comprising one double bond
  C-term NH2
QSQQTFANLWRLLAQN

SEQ ID NO: 479 - protein, 16 aa, Artificial Sequence
  Description of Artificial Sequence: Synthetic peptide
  N-term Ac
  MOD_RES (7)..(7): Alpha-Me R-alkyne 1,5 triazole (5 carbon) alanine olefin amino acid connected by an all-carbon crosslinker comprising one double bond
  misc_feature (7)..(14): Crosslink between residues
  MOD_RES (14)..(14): Alpha-Me azide 1,5 triazole (6 carbon) alanine olefin amino acid connected by an all-carbon crosslinker comprising one double bond
  C-term NH2
QSQQTFANLWRLLAQN

SEQ ID NO: 480 - protein, 16 aa, Artificial Sequence
  Description of Artificial Sequence: Synthetic peptide
  N-term Ac
  MOD_RES (7)..(7): Alpha-Me R-alkyne 1,4 triazole (5 carbon) alanine olefin amino acid connected by an all-carbon crosslinker comprising one double bond
  misc_feature (7)..(14): Crosslink between residues
  MOD_RES (14)..(14): Alpha-Me azide 1,4 triazole (5 carbon) alanine olefin amino acid connected by an all-carbon crosslinker comprising one double bond
  C-term NH2
QSQQTFANLWRLLAQN

SEQ ID NO: 481 - protein, 16 aa, Artificial Sequence
  Description of Artificial Sequence: Synthetic peptide
  N-term Ac
  MOD_RES (7)..(7): Alpha-Me R-alkyne 1,4 triazole (5 carbon) alanine olefin amino acid connected by an all-carbon crosslinker comprising one double bond
  misc_feature (7)..(14): Crosslink between residues
  MOD_RES (14)..(14): Alpha-Me azide 1,4 triazole (6 carbon) alanine olefin amino acid connected by an all-carbon crosslinker comprising one double bond
  C-term NH2
QSQQTFANLWRLLAQN

SEQ ID NO: 482 - protein, 16 aa, Artificial Sequence
  Description of Artificial Sequence: Synthetic peptide
  N-term Ac
  MOD_RES (7)..(7): Alpha-Me R-azide 1,4 triazole (6 carbon) alanine olefin amino acid connected by an all-carbon crosslinker comprising one double bond
  misc_feature (7)..(14): Crosslink between residues
  MOD_RES (14)..(14): Alpha-Me alkyne 1,4 triazole (5 carbon) alanine olefin amino acid connected by an all-carbon crosslinker comprising one double bond
  C-term NH2
QSQQTFANLWRLLAQN

SEQ ID NO: 483 - protein, 16 aa, Artificial Sequence
  Description of Artificial Sequence: Synthetic peptide
  N-term Ac
  MOD_RES (7)..(7): Alpha-Me R-azide 1,5 triazole (6 carbon) alanine olefin amino acid connected by an all-carbon crosslinker comprising one double bond
  misc_feature (7)..(14): Crosslink between residues
  MOD_RES (14)..(14): Alpha-Me alkyne 1,5 triazole (6 carbon) alanine olefin amino acid connected by an all-carbon crosslinker comprising one double bond
  C-term NH2
QSQQTFANLWRLLAQN

SEQ ID NO: 484 - protein, 16 aa, Artificial Sequence
  Description of Artificial Sequence: Synthetic peptide
  N-term Ac
  MOD_RES (7)..(7): Alpha-Me R-alkyne 1,5 triazole (6 carbon) alanine olefin amino acid connected by an all-carbon crosslinker comprising one double bond
  misc_feature (7)..(14): Crosslink between residues
  MOD_RES (14)..(14): Alpha-Me azide 1,5 triazole (6 carbon) alanine olefin amino acid connected by an all-carbon crosslinker comprising one double bond
  C-term NH2
QSQQTFANLWRLLAQN

SEQ ID NO: 485 - protein, 16 aa, Artificial Sequence
  Description of Artificial Sequence: Synthetic peptide
  N-term Ac
  MOD_RES (7)..(7): Alpha-Me R-azide 1,4 triazole (6 carbon) alanine olefin amino acid connected by an all-carbon crosslinker comprising one double bond
  misc_feature (7)..(14): Crosslink between residues
  MOD_RES (14)..(14): Alpha-Me alkyne 1,4 triazole (6 carbon) alanine olefin amino acid connected by an all-carbon crosslinker comprising one double bond
  C-term NH2
QSQQTFANLWRLLAQN

SEQ ID NO: 486 - protein, 16 aa, Artificial Sequence
  Description of Artificial Sequence: Synthetic peptide
  N-term Ac
  MOD_RES (7)..(7): Alpha-Me R-alkyne 1,4 triazole (6 carbon) alanine olefin amino acid connected by an all-carbon crosslinker comprising one double bond
  misc_feature (7)..(14): Crosslink between residues
  MOD_RES (14)..(14): Alpha-Me azide 1,4 triazole (6 carbon) alanine olefin amino acid connected by an all-carbon crosslinker comprising one double bond
  C-term NH2
QSQQTFANLWRLLAQN

SEQ ID NO: 487 - protein, 16 aa, Artificial Sequence
  Description of Artificial Sequence: Synthetic peptide
  N-term Ac
  MOD_RES (7)..(7): Alpha-Me R-azide 1,4 triazole (5 carbon) alanine olefin amino acid connected by an all-carbon crosslinker comprising one double bond
  misc_feature (7)..(14): Crosslink between residues
  MOD_RES (14)..(14): Alpha-Me alkyne 1,4 triazole (6 carbon) alanine olefin amino acid connected by an all-carbon crosslinker comprising one double bond
  C-term NH2
QSQQTFANLWRLLAQN

SEQ ID NO: 488 - protein, 16 aa, Artificial Sequence
  Description of Artificial Sequence: Synthetic peptide
  N-term Ac
  MOD_RES (7)..(7): 4Me-Alpha-Me R-azide 1,5 triazole (6 carbon) alanine olefin amino acid connected by an all-carbon crosslinker comprising one double bond
  misc_feature (7)..(14): Crosslink between residues
  MOD_RES (14)..(14): 4Me-alpha-Me alkyne 1,5 triazole (5 carbon) alanine olefin amino acid connected by an all-carbon crosslinker comprising one double bond
  C-term NH2
QSQQTFANLWRLLAQN

SEQ ID NO: 489 - protein, 12 aa, Artificial Sequence
  Description of Artificial Sequence: Synthetic peptide
  N-term Ac
  MOD_RES (4)..(4): Alpha-Me R-alkyne 1,4 triazole (5 carbon) alanine olefin amino acid connected by an all-carbon crosslinker comprising one double bond
  misc_feature (4)..(11): Crosslink between residues
  MOD_RES (11)..(11): Alpha-Me azide 1,4 triazole (6 carbon) alanine olefin amino acid connected by an all-carbon crosslinker comprising one double bond
  C-term NH2
LTFAHYWAQLAS

SEQ ID NO: 490 - protein, 10 aa, Artificial Sequence
  Description of Artificial Sequence: Synthetic peptide
  N-term H
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  C-term NH2
FAHYWAQLAS

SEQ ID NO: 491 - protein, 12 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAHYWAQLAS

SEQ ID NO: 492 - protein, 10 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  C-term NH2
FAHYWAQLAS

SEQ ID NO: 493 - protein, 12 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (6 carbon) alanine olefin amino acid connected by an all-carbon crosslinker comprising one double bond
  C-term NH2
LTFAHYWAQLAS

SEQ ID NO: 494 - protein, 12 aa, Artificial Sequence
  Description of Artificial Sequence: Synthetic peptide
  N-term Ac
  MOD_RES (4)..(4): Alpha-Me R-alkyne 1,5 triazole (5 carbon) alanine olefin amino acid connected by an all-carbon crosslinker comprising one double bond
  misc_feature (4)..(11): Crosslink between residues
  MOD_RES (11)..(11): Alpha-Me azide 1,5 triazole (6 carbon) alanine olefin amino acid connected by an all-carbon crosslinker comprising one double bond
  C-term NH2
LTFAHYWAQLAS

SEQ ID NO: 495 - protein, 12 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLAA

SEQ ID NO: 496 - protein, 12 aa, Artificial Sequence
  Description of Artificial Sequence: Synthetic peptide
  N-term Ac
  MOD_RES (4)..(4): Alpha-Me R-alkyne 1,5 triazole (5 carbon) alanine olefin amino acid connected by an all-carbon crosslinker comprising one double bond
  misc_feature (4)..(11): Crosslink between residues
  MOD_RES (11)..(11): Alpha-Me azide 1,5 triazole (6 carbon) alanine olefin amino acid connected by an all-carbon crosslinker comprising one double bond
  C-term NH2
LTFAHYWAQLAS

SEQ ID NO: 497 - protein, 12 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLAA

SEQ ID NO: 498 - protein, 12 aa, Artificial Sequence
  Description of Artificial Sequence: Synthetic peptide
  N-term Ac
  C-term NH2
LTFEHYWAQLTS

SEQ ID NO: 499 - protein, 12 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (7)..(7): Ac3c
  MOD_RES (9)..(9): Alpha-methyl-L-cysteine connected by an i to i+7, seven-methylene crosslinker to another thiol-containing amino acid
  C-term NH2
FCAYWEXLCAAA

SEQ ID NO: 500 - protein, 12 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (7)..(7): Ac3c
  MOD_RES (9)..(9): Alpha-methyl-L-cysteine connected by an i to i+7, seven-methylene crosslinker to another thiol-containing amino acid
  MOD_RES (11)..(11): 2-aminoisobutyric acid
  C-term NH2
FCAYWEXLCAXA

SEQ ID NO: 501 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAYWAQLCSAL

SEQ ID NO: 502 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAYWAQLCSAL

SEQ ID NO: 503 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAYWAQLCSAM

SEQ ID NO: 504 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): homo-Leu
  C-term NH2
LTFCAYWAQLCSAL

SEQ ID NO: 505 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAYWAQLCSAF

SEQ ID NO: 506 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAYWAQLCSAI

SEQ ID NO: 507 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Cyclohexyl-Gly
  C-term NH2
LTFCAYWAQLCSAG

SEQ ID NO: 508 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): 2-aminoisobutyric acid
  C-term NH2
LTFCAYWAQLCSAX

SEQ ID NO: 509 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAYWAQLCSAA

SEQ ID NO: 510 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(9): Crosslink between residues
  MOD_RES (9)..(9): Alpha-methyl-L-cysteine connected by an i to i+7, seven-methylene crosslinker to another thiol-containing amino acid
  MOD_RES (11)..(11): Alpha-methyl-L-cysteine connected by an i to i+7, seven-methylene crosslinker to another thiol-containing amino acid
  misc_feature (11)..(13): Crosslink between residues
  MOD_RES (13)..(13): Alpha-methyl-L-cysteine connected by an i to i+7, seven-methylene crosslinker to another thiol-containing amino acid
  MOD_RES (14)..(14): Norleucine
  C-term NH2
LTFCAYWACLCSCL

SEQ ID NO: 511 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(9): Crosslink between residues
  MOD_RES (9)..(9): Alpha-methyl-L-cysteine connected by an i to i+7, seven-methylene crosslinker to another thiol-containing amino acid
  MOD_RES (11)..(11): Alpha-methyl-L-cysteine connected by an i to i+7, seven-methylene crosslinker to another thiol-containing amino acid
  misc_feature (11)..(13): Crosslink between residues
  MOD_RES (13)..(13): Alpha-methyl-L-cysteine connected by an i to i+7, seven-methylene crosslinker to another thiol-containing amino acid
  C-term NH2
LTFCAYWACLCSCA

SEQ ID NO: 512 - protein, 12 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (7)..(7): Ac3c
  MOD_RES (9)..(9): Alpha-methyl-L-cysteine connected by an i to i+7, seven-methylene crosslinker to another thiol-containing amino acid
  MOD_RES (12)..(12): Norleucine
  C-term NH2
FCAYWEXLCAAL

SEQ ID NO: 513 - protein, 12 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (7)..(7): Ac3c
  MOD_RES (9)..(9): Alpha-methyl-L-cysteine connected by an i to i+7, seven-methylene crosslinker to another thiol-containing amino acid
  C-term NH2
FCAYWEXLCAAL

SEQ ID NO: 514 - protein, 12 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (7)..(7): Ac3c
  MOD_RES (9)..(9): Alpha-methyl-L-cysteine connected by an i to i+7, seven-methylene crosslinker to another thiol-containing amino acid
  C-term NH2
FCAYWEXLCAAM

SEQ ID NO: 515 - protein, 12 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (7)..(7): Ac3c
  MOD_RES (9)..(9): Alpha-methyl-L-cysteine connected by an i to i+7, seven-methylene crosslinker to another thiol-containing amino acid
  MOD_RES (12)..(12): homo-Leu
  C-term NH2
FCAYWEXLCAAL

SEQ ID NO: 516 - protein, 12 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (7)..(7): Ac3c
  MOD_RES (9)..(9): Alpha-methyl-L-cysteine connected by an i to i+7, seven-methylene crosslinker to another thiol-containing amino acid
  C-term NH2
FCAYWEXLCAAF

SEQ ID NO: 517 - protein, 12 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (7)..(7): Ac3c
  MOD_RES (9)..(9): Alpha-methyl-L-cysteine connected by an i to i+7, seven-methylene crosslinker to another thiol-containing amino acid
  C-term NH2
FCAYWEXLCAAI

SEQ ID NO: 518 - protein, 12 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (7)..(7): Ac3c
  MOD_RES (9)..(9): Alpha-methyl-L-cysteine connected by an i to i+7, seven-methylene crosslinker to another thiol-containing amino acid
  MOD_RES (12)..(12): Cyclohexyl-Gly
  C-term NH2
FCAYWEXLCAAG

SEQ ID NO: 519 - protein, 12 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (7)..(7): Ac3c
  MOD_RES (9)..(9): Alpha-methyl-L-cysteine connected by an i to i+7, seven-methylene crosslinker to another thiol-containing amino acid
  MOD_RES (12)..(12): Cyclohexyl-Ala
  C-term NH2
FCAYWEXLCAAA

SEQ ID NO: 520 - protein, 12 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (7)..(7): Ac3c
  MOD_RES (9)..(9): Alpha-methyl-L-cysteine connected by an i to i+7, seven-methylene crosslinker to another thiol-containing amino acid
  MOD_RES (12)..(12): 2-aminoisobutyric acid
  C-term NH2
FCAYWEXLCAAX

SEQ ID NO: 521 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): 2-aminoisobutyric acid
  C-term NH2
LTFCAYWAQLCAAXV

SEQ ID NO: 522 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): 2-aminoisobutyric acid
  C-term NH2
LTFCAYWAQLCAAXV

SEQ ID NO: 523 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (13)..(13): 2-aminoisobutyric acid
  C-term NH2
LTFCAYWAQLCSXAA

SEQ ID NO: 524 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (13)..(13): 2-aminoisobutyric acid
  C-term NH2
LTFCAYWAQLCSXAA

SEQ ID NO: 525 - protein, 16 aa, Artificial Sequence
  Description of Artificial Sequence: Synthetic peptide
  N-term Ac
  MOD_RES (5)..(5): Alpha-methyl-D-cysteine connected by an i to i+7, seven-methylene crosslinker to another thiol-containing amino acid
  misc_feature (5)..(12): Crosslink between residues
  MOD_RES (12)..(12): Alpha-methyl-L-cysteine connected by an i to i+7, seven-methylene crosslinker to another thiol-containing amino acid
  MOD_RES (15)..(16): Norleucine
  C-term NH2
HLTFCHHWHQLCAALL

SEQ ID NO: 526 - protein, 16 aa, Artificial Sequence
  Description of Artificial Sequence: Synthetic peptide
  N-term Ac
  MOD_RES (5)..(5): Alpha-methyl-D-cysteine connected by an i to i+7, seven-methylene crosslinker to another thiol-containing amino acid
  misc_feature (5)..(12): Crosslink between residues
  MOD_RES (12)..(12): Alpha-methyl-L-cysteine connected by an i to i+7, seven-methylene crosslinker to another thiol-containing amino acid
  C-term NH2
DLTFCHHWHQLCRRLV

SEQ ID NO: 527 - protein, 16 aa, Artificial Sequence
  Description of Artificial Sequence: Synthetic peptide
  N-term Ac
  MOD_RES (5)..(5): Alpha-methyl-D-cysteine connected by an i to i+7, seven-methylene crosslinker to another thiol-containing amino acid
  misc_feature (5)..(12): Crosslink between residues
  MOD_RES (12)..(12): Alpha-methyl-L-cysteine connected by an i to i+7, seven-methylene crosslinker to another thiol-containing amino acid
  C-term NH2
HHTFCHHWHQLCAAML

SEQ ID NO: 528 - protein, 13 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  MOD_RES (13)..(13): Cyclohexyl-Ala
  C-term NH2
FCHHWHQLCRRDA

SEQ ID NO: 529 - protein, 13 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  C-term NH2
FCHHWHQLCHRFV

SEQ ID NO: 530 - protein, 16 aa, Artificial Sequence
  Description of Artificial Sequence: Synthetic peptide
  N-term Ac
  MOD_RES (5)..(5): Alpha-methyl-D-cysteine connected by an i to i+7, seven-methylene crosslinker to another thiol-containing amino acid
  misc_feature (5)..(12): Crosslink between residues
  MOD_RES (12)..(12): Alpha-methyl-L-cysteine connected by an i to i+7, seven-methylene crosslinker to another thiol-containing amino acid
  MOD_RES (15)..(15): homo-Leu
  C-term NH2
HLTFCHHWHQLCAALA

SEQ ID NO: 531 - protein, 16 aa, Artificial Sequence
  Description of Artificial Sequence: Synthetic peptide
  N-term Ac
  MOD_RES (5)..(5): Alpha-methyl-D-cysteine connected by an i to i+7, seven-methylene crosslinker to another thiol-containing amino acid
  misc_feature (5)..(12): Crosslink between residues
  MOD_RES (12)..(12): Alpha-methyl-L-cysteine connected by an i to i+7, seven-methylene crosslinker to another thiol-containing amino acid
  MOD_RES (15)..(15): Cyclohexyl-Gly
  MOD_RES (16)..(16): D-amino acid
  C-term NH2
DLTFCHHWHQLCRRGL

SEQ ID NO: 532 - protein, 16 aa, Artificial Sequence
  Description of Artificial Sequence: Synthetic peptide
  N-term Ac
  MOD_RES (5)..(5): Alpha-methyl-D-cysteine connected by an i to i+7, seven-methylene crosslinker to another thiol-containing amino acid
  misc_feature (5)..(12): Crosslink between residues
  MOD_RES (12)..(12): Alpha-methyl-L-cysteine connected by an i to i+7, seven-methylene crosslinker to another thiol-containing amino acid
  MOD_RES (15)..(15): Cyclohexyl-Gly
  MOD_RES (16)..(16): D-amino acid
  C-term NH2
DLTFCHHWHQLCRRGL

SEQ ID NO: 533 - protein, 16 aa, Artificial Sequence
  Description of Artificial Sequence: Synthetic peptide
  N-term Ac
  MOD_RES (5)..(5): Alpha-methyl-D-cysteine connected by an i to i+7, seven-methylene crosslinker to another thiol-containing amino acid
  misc_feature (5)..(12): Crosslink between residues
  MOD_RES (12)..(12): Alpha-methyl-L-cysteine connected by an i to i+7, seven-methylene crosslinker to another thiol-containing amino acid
  MOD_RES (15)..(15): Cyclohexyl-Ala
  MOD_RES (16)..(16): D-amino acid
  C-term NH2
HHTFCHHWHQLCAAAV

SEQ ID NO: 534 - protein, 13 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  MOD_RES (13)..(13): D-amino acid
  C-term NH2
FCHHWHQLCRRDA

SEQ ID NO: 535 - protein, 13 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  MOD_RES (12)..(12): 2-aminoisobutyric acid
  C-term NH2
FCHHWHQLCHRXG

SEQ ID NO: 536 - protein, 13 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  MOD_RES (12)..(12): Norleucine
  C-term NH2
FCAYWAQLCHHLL

SEQ ID NO: 537 - protein, 13 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  MOD_RES (13)..(13): Norleucine
  C-term NH2
FCAYWSALCHQAL

SEQ ID NO: 538 - protein, 13 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  MOD_RES (12)..(12): Cyclohexyl-Gly
  MOD_RES (13)..(13): D-amino acid
  C-term NH2
FCAYWVQLCQHGL

SEQ ID NO: 539 - protein, 13 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  MOD_RES (12)..(12): Norleucine
  MOD_RES (13)..(13): D-amino acid
  C-term NH2
FCAYWTALCQQLV

SEQ ID NO: 540 - protein, 13 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  MOD_RES (11)..(11): 2-aminoisobutyric acid
  MOD_RES (13)..(13): D-amino acid
  C-term NH2
FCAYWYQLCHXAA

SEQ ID NO: 541 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAYWAQLCHHLA

SEQ ID NO: 542 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAYWAQLCHHLA

SEQ ID NO: 543 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (15)..(15): D-amino acid
  C-term NH2
LTFCAYWAQLCHQLV

SEQ ID NO: 544 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (15)..(15): D-amino acid
  C-term NH2
LTFCAYWAQLCHQLV

SEQ ID NO: 545 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAYWAQLCQQML

SEQ ID NO: 546 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAYWAQLCQQML

SEQ ID NO: 547 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (13)..(13): 2-aminoisobutyric acid
  MOD_RES (14)..(14): homo-Leu
  C-term NH2
LTFCAYWAQLCHXLV

SEQ ID NO: 548 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAYWAQLCAHFA

SEQ ID NO: 549 - protein, 16 aa, Artificial Sequence
  Description of Artificial Sequence: Synthetic peptide
  N-term Ac
  MOD_RES (5)..(5): Alpha-methyl-D-cysteine connected by an i to i+7, seven-methylene crosslinker to another thiol-containing amino acid
  misc_feature (5)..(12): Crosslink between residues
  MOD_RES (12)..(12): Alpha-methyl-L-cysteine connected by an i to i+7, seven-methylene crosslinker to another thiol-containing amino acid
  MOD_RES (15)..(15): Norleucine
  MOD_RES (16)..(16): D-amino acid
  C-term NH2
HLTFCHHWHQLCAALL

SEQ ID NO: 550 - protein, 16 aa, Artificial Sequence
  Description of Artificial Sequence: Synthetic peptide
  N-term Ac
  MOD_RES (5)..(5): Alpha-methyl-D-cysteine connected by an i to i+7, seven-methylene crosslinker to another thiol-containing amino acid
  misc_feature (5)..(12): Crosslink between residues
  MOD_RES (12)..(12): Alpha-methyl-L-cysteine connected by an i to i+7, seven-methylene crosslinker to another thiol-containing amino acid
  MOD_RES (16)..(16): D-amino acid
  C-term NH2
DLTFCHHWHQLCRRLA

SEQ ID NO: 551 - protein, 16 aa, Artificial Sequence
  Description of Artificial Sequence: Synthetic peptide
  N-term Ac
  MOD_RES (5)..(5): Alpha-methyl-D-cysteine connected by an i to i+7, seven-methylene crosslinker to another thiol-containing amino acid
  misc_feature (5)..(12): Crosslink between residues
  MOD_RES (12)..(12): Alpha-methyl-L-cysteine connected by an i to i+7, seven-methylene crosslinker to another thiol-containing amino acid
  MOD_RES (16)..(16): D-amino acid
  C-term NH2
HHTFCHHWHQLCAAMV

SEQ ID NO: 552 - protein, 13 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  C-term NH2
FCHHWHQLCRRDA

SEQ ID NO: 553 - protein, 13 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  MOD_RES (13)..(13): Cyclohexyl-Ala
  C-term NH2
FCHHWHQLCHRFA

SEQ ID NO: 554 - protein, 11 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  C-term NHAm
FCAYWEALCAA

SEQ ID NO: 555 - protein, 11 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  C-term NHiAm
FCAYWEALCAA

SEQ ID NO: 556 - protein, 11 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  C-term NHnPr3Ph
FCAYWEALCAA

SEQ ID NO: 557 - protein, 11 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  C-term NHnBu33Me
FCAYWEALCAA

SEQ ID NO: 558 - protein, 11 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  C-term NHnPr
FCAYWEALCAA

SEQ ID NO: 559 - protein, 11 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  C-term NHnEt2Ch
FCAYWEALCAA

SEQ ID NO: 560 - protein, 11 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  C-term NHnEt2Cp
FCAYWEALCAA

SEQ ID NO: 561 - protein, 11 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  C-term NHHex
FCAYWEALCAA

SEQ ID NO: 562 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAYWAQLCAAIA

SEQ ID NO: 563 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAYWAQLCAAIA

SEQ ID NO: 564 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAYWAALCAAMA

SEQ ID NO: 565 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAYWAALCAAMA

SEQ ID NO: 566 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAYWAQLCAALA

SEQ ID NO: 567 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAYWAQLCAALA

SEQ ID NO: 568 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAYWAQLCAAIA

SEQ ID NO: 569 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAYWAQLCAAIA

SEQ ID NO: 570 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAYWAALCAAMA

SEQ ID NO: 571 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAYWAALCAAMA

SEQ ID NO: 572 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (15)..(15): D-amino acid
  C-term NH2
LTFCAYWAQLCAALA

SEQ ID NO: 573 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (15)..(15): D-amino acid
  C-term NH2
LTFCAYWAQLCAALA

SEQ ID NO: 574 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAYWAALCAAIV

SEQ ID NO: 575 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAYWAALCAAIV

SEQ ID NO: 576 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAYWAQLCAAMV

SEQ ID NO: 577 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (15)..(15): D-amino acid
  C-term NH2
LTFCAYWAALCAALV

SEQ ID NO: 578 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (15)..(15): D-amino acid
  C-term NH2
LTFCAYWAALCAALV

SEQ ID NO: 579 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAYWAQLCAAIL

SEQ ID NO: 580 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAYWAQLCAAIL

SEQ ID NO: 581 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAYWAALCAAML

SEQ ID NO: 582 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (15)..(15): D-amino acid
  C-term NH2
LTFCAYWAQLCAALL

SEQ ID NO: 583 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (15)..(15): D-amino acid
  C-term NH2
LTFCAYWAQLCAALL

SEQ ID NO: 584 - protein, 13 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  C-term NH2
FCAYWEALCAAMA

SEQ ID NO: 585 - protein, 13 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  MOD_RES (12)..(12): Norleucine
  C-term NH2
FCAYWEALCAALA

SEQ ID NO: 586 - protein, 13 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  MOD_RES (13)..(13): D-amino acid
  C-term NH2
FCAYWEALCAAIA

SEQ ID NO: 587 - protein, 13 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  MOD_RES (13)..(13): D-amino acid
  C-term NH2
FCAYWEALCAAMA

SEQ ID NO: 588 - protein, 13 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  MOD_RES (12)..(12): Norleucine
  MOD_RES (13)..(13): D-amino acid
  C-term NH2
FCAYWEALCAALA

SEQ ID NO: 589 - protein, 13 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  MOD_RES (13)..(13): D-amino acid
  C-term NH2
FCAYWEALCAAIV

SEQ ID NO: 590 - protein, 13 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  MOD_RES (13)..(13): D-amino acid
  C-term NH2
FCAYWEALCAAMV

SEQ ID NO: 591 - protein, 13 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  MOD_RES (12)..(12): Norleucine
  MOD_RES (13)..(13): D-amino acid
  C-term NH2
FCAYWEALCAALV

SEQ ID NO: 592 - protein, 13 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  MOD_RES (13)..(13): D-amino acid
  C-term NH2
FCAYWEALCAAIL

SEQ ID NO: 593 - protein, 13 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  MOD_RES (13)..(13): D-amino acid
  C-term NH2
FCAYWEALCAAML

SEQ ID NO: 594 - protein, 13 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  MOD_RES (12)..(12): Norleucine
  MOD_RES (13)..(13): D-amino acid
  C-term NH2
FCAYWEALCAALL

SEQ ID NO: 595 - protein, 13 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (9)..(9): Alpha-methyl-L-cysteine connected by an i to i+7, seven-methylene crosslinker to another thiol-containing amino acid
  MOD_RES (12)..(12): Norleucine
  MOD_RES (13)..(13): D-amino acid
  C-term NH2
FCAYWEALCAALL

SEQ ID NO: 596 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (7)..(7): 6cl-Trp
  MOD_RES (11)..(11): Alpha-methyl-L-cysteine connected by an i to i+7, seven-methylene crosslinker to another thiol-containing amino acid
  C-term NH2
LTFCAYWAQLCSAA

SEQ ID NO: 597 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (7)..(7): 6cl-Trp
  MOD_RES (11)..(11): Alpha-methyl-L-cysteine connected by an i to i+7, seven-methylene crosslinker to another thiol-containing amino acid
  C-term NH2
LTFCAYWAQLCSAA

SEQ ID NO: 598 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
WTFCFYWSQLCAVAA

SEQ ID NO: 599 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
WTFCFYWSQLCAVAA

SEQ ID NO: 600 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
WTFCVYWSQLCAVA

SEQ ID NO: 601 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
WTFCVYWSQLCAVA

SEQ ID NO: 602 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
WTFCFYWSQLCSAAA

SEQ ID NO: 603 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
WTFCFYWSQLCSAAA

SEQ ID NO: 604 - protein, 16 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(16): D-amino acid
  C-term NH2
WTFCVYWSQLCAVAAA

SEQ ID NO: 605 - protein, 16 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(16): D-amino acid
  C-term NH2
WTFCVYWSQLCAVAAA

SEQ ID NO: 606 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAYWAQLCAVG

SEQ ID NO: 607 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAYWAQLCAVG

SEQ ID NO: 608 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAYWAQLCAVQ

SEQ ID NO: 609 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAYWAQLCAVQ

SEQ ID NO: 610 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): D-amino acid
  C-term NH2
LTFCAYWAQLCSAA

SEQ ID NO: 611 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): D-amino acid
  C-term NH2
LTFCAYWAQLCSAA

SEQ ID NO: 612 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): homo-Leu
  MOD_RES (11)..(11): Alpha-methyl-L-cysteine connected by an i to i+7, seven-methylene crosslinker to another thiol-containing amino acid
  C-term NH2
LTFCAYWAQLCSAA

SEQ ID NO: 613 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): homo-Leu
  MOD_RES (11)..(11): Alpha-methyl-L-cysteine connected by an i to i+7, seven-methylene crosslinker to another thiol-containing amino acid
  C-term NH2
LTFCAYWAQLCSAA

SEQ ID NO: 614 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Amino acid comprising two pentenyl-alanine olefin side chains, each of which is crosslinked to another amino acid as indicated
  misc_feature (11)..(14): Crosslink between residues
  MOD_RES (14)..(14): Alpha-methyl-L-cysteine connected by an i to i+7, seven-methylene crosslinker to another thiol-containing amino acid
  C-term NH2
LTFCAYWEQLASAC

SEQ ID NO: 615 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAYWAQLCSLA

SEQ ID NO: 616 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAYWAQLCSLA

SEQ ID NO: 617 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAYWAQLCSWA

SEQ ID NO: 618 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAYWAQLCSWA

SEQ ID NO: 619 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAYWAQLCSVS

SEQ ID NO: 620 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAYWAQLCSAS

SEQ ID NO: 621 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAYWAQLCSVG

SEQ ID NO: 622 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): D-amino acid
  C-term NH2
ETFCVYWAQLCSAA

SEQ ID NO: 623 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
ETFCVYWAQLCSAA

SEQ ID NO: 624 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
ETFCVYWAQLCSVA

SEQ ID NO: 625 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
ETFCVYWAQLCSLA

SEQ ID NO: 626 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
ETFCVYWAQLCSWA

SEQ ID NO: 627 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
ETFCKYWAQLCSWA

SEQ ID NO: 628 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
ETFCVYWAQLCSVS

SEQ ID NO: 629 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
ETFCVYWAQLCSAS

SEQ ID NO: 630 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
ETFCVYWAQLCSVG

SEQ ID NO: 631 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): D-amino acid
  C-term NH2
LTFCVYWAQLCSSA

SEQ ID NO: 632 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): D-amino acid
  C-term NH2
ETFCVYWAQLCSSA

SEQ ID NO: 633 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): D-amino acid
  C-term NH2
LTFCVYWAQLCSNA

SEQ ID NO: 634 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): D-amino acid
  C-term NH2
ETFCVYWAQLCSNA

SEQ ID NO: 635 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): D-amino acid
  C-term NH2
LTFCVYWAQLCSAA

SEQ ID NO: 636 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCVYWAQLCSVA

SEQ ID NO: 637 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCVYWAQLCSVA

SEQ ID NO: 638 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCVYWAQLCSWA

SEQ ID NO: 639 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCVYWAQLCSVS

SEQ ID NO: 640 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCVYWAQLCSVS

SEQ ID NO: 641 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCVYWAQLCSAS

SEQ ID NO: 642 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCVYWAQLCSAS

SEQ ID NO: 643 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCVYWAQLCSVG

SEQ ID NO: 644 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCVYWAQLCSVG

SEQ ID NO: 645 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclohexyl-Ala
  MOD_RES (11)..(11): Alpha-methyl-L-cysteine connected by an i to i+7, seven-methylene crosslinker to another thiol-containing amino acid
  C-term NH2
LTFCEYWAQACSAA

SEQ ID NO: 646 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclohexyl-Ala
  MOD_RES (11)..(11): Alpha-methyl-L-cysteine connected by an i to i+7, seven-methylene crosslinker to another thiol-containing amino acid
  C-term NH2
LTFCEYWAQACSAA

SEQ ID NO: 647 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclopentyl-Gly
  MOD_RES (11)..(11): Alpha-methyl-L-cysteine connected by an i to i+7, seven-methylene crosslinker to another thiol-containing amino acid
  C-term NH2
LTFCEYWAQGCSAA

SEQ ID NO: 648 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclopentyl-Gly
  MOD_RES (11)..(11): Alpha-methyl-L-cysteine connected by an i to i+7, seven-methylene crosslinker to another thiol-containing amino acid
  C-term NH2
LTFCEYWAQGCSAA

SEQ ID NO: 649 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCEYWAQFCSAA

SEQ ID NO: 650 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCEYWAQFCSAA

SEQ ID NO: 651 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCEYWAQACSAA

SEQ ID NO: 652 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCEYWAQACSAA

SEQ ID NO: 653 - protein, 14 aa, Artificial Sequence
  Description of Artificial Sequence: Synthetic peptide
  N-term Ac
  MOD_RES (3)..(3): 3-chloro-Phe
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCEYWAQLCSAA

SEQ ID NO: 654 - protein, 14 aa, Artificial Sequence
  Description of Artificial Sequence: Synthetic peptide
  N-term Ac
  MOD_RES (3)..(3): 3-chloro-Phe
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCEYWAQLCSAA

SEQ ID NO: 655 - protein, 14 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCEYWAQLCSAA

SEQ ID NO: 656 - protein, 14 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCEYWAQLCSAA

SEQ ID NO: 657 - protein, 14 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): homo-Leu
  MOD_RES (11)..(11): Alpha-methyl-L-cysteine connected by an i to i+7, seven-methylene crosslinker to another thiol-containing amino acid
  C-term NH2
LTFCEYWAQLCSAA

SEQ ID NO: 658 - protein, 14 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): homo-Leu
  MOD_RES (11)..(11): Alpha-methyl-L-cysteine connected by an i to i+7, seven-methylene crosslinker to another thiol-containing amino acid
  C-term NH2
LTFCEYWAQLCSAA

SEQ ID NO: 659 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
ETFCEYWAQLCSAA

SEQ ID NO: 660 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAYWVQLCSAA

SEQ ID NO: 661 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAHWAQLCSAA

SEQ ID NO: 662 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAEWAQLCSAA

SEQ ID NO: 663 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCASWAQLCSAA

SEQ ID NO: 664 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAEWAQLCSAA

SEQ ID NO: 665 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCASWAQLCSAA

SEQ ID NO: 666 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (6)..(6): 4-carboxy-Phe
  MOD_RES (11)..(11): Alpha-methyl-L-cysteine connected by an i to i+7, seven-methylene crosslinker to another thiol-containing amino acid
  C-term NH2
LTFCAFWAQLCSAA

SEQ ID NO: 667 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (6)..(6): 4-carboxy-Phe
  MOD_RES (11)..(11): Alpha-methyl-L-cysteine connected by an i to i+7, seven-methylene crosslinker to another thiol-containing amino acid
  C-term NH2
LTFCAFWAQLCSAA

SEQ ID NO: 668 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAHWAQLCAAIA

SEQ ID NO: 669 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
ITFCFYWAQLCAAIA

SEQ ID NO: 670 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
ITFCEHWAQLCAAIA

SEQ ID NO: 671 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
ITFCEHWAQLCAAIA

SEQ ID NO: 672 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
ETFCEHWAQLCAAIA

SEQ ID NO: 673 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
ETFCEHWAQLCAAIA

SEQ ID NO: 674 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAHWVQLCAAIA

SEQ ID NO: 675 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
ITFCFYWVQLCAAIA

SEQ ID NO: 676 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
ITFCEYWVQLCAAIA

SEQ ID NO: 677 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
ITFCEHWVQLCAAIA

SEQ ID NO: 678 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAEWAQLCAAIA

SEQ ID NO: 679 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (6)..(6): 4-carboxy-Phe
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAFWAQLCAAIA

SEQ ID NO: 680 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (6)..(6): 4-carboxy-Phe
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAFWAQLCAAIA

SEQ ID NO: 681 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAHWAQLCAHFA

SEQ ID NO: 682 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
ITFCFYWAQLCAHFA

SEQ ID NO: 683 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
ITFCFYWAQLCAHFA

SEQ ID NO: 684 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
ITFCFHWAQLCAEFA

SEQ ID NO: 685 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
ITFCFHWAQLCAEFA

SEQ ID NO: 686 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
ITFCEHWAQLCAHFA

SEQ ID NO: 687 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
ITFCEHWAQLCAHFA

SEQ ID NO: 688 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAHWVQLCAHFA

SEQ ID NO: 689 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
ITFCFYWVQLCAHFA

SEQ ID NO: 690 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
ITFCEYWVQLCAHFA

SEQ ID NO: 691 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
ITFCEHWVQLCAHFA

SEQ ID NO: 692 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
ITFCEHWVQLCAHFA

SEQ ID NO: 693 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
ETFCEYWAALCSAA

SEQ ID NO: 694 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAYWVALCSAA

SEQ ID NO: 695 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAHWAALCSAA

SEQ ID NO: 696 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAEWAALCSAA

SEQ ID NO: 697 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAEWAALCSAA

SEQ ID NO: 698 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCASWAALCSAA

SEQ ID NO: 699 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCASWAALCSAA

SEQ ID NO: 700 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAYWAALCAAIA

SEQ ID NO: 701 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAYWAALCAAIA

SEQ ID NO: 702 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCAYWAALCAHFA

SEQ ID NO: 703 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCEHWAQLCAHIA

SEQ ID NO: 704 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCEHWAQLCAHIA

SEQ ID NO: 705 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAHWAQLCAHIA

SEQ ID NO: 706 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCEYWAQLCAHIA

SEQ ID NO: 707 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAYWAQLCAAFA

SEQ ID NO: 708 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAYWAQLCAAFA

SEQ ID NO: 709 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAYWAQLCAAWA

SEQ ID NO: 710 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAYWAQLCAAVA

SEQ ID NO: 711 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAYWAQLCAAVA

SEQ ID NO: 712 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAYWAQLCAALA

SEQ ID NO: 713 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAYWAQLCAALA

SEQ ID NO: 714 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCEYWAQLCAAIA

SEQ ID NO: 715 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCEYWAQLCAAIA

SEQ ID NO: 716 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCEYWAQLCAAFA

SEQ ID NO: 717 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCEYWAQLCAAFA

SEQ ID NO: 718 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCEYWAQLCAAVA

SEQ ID NO: 719 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCEYWAQLCAAVA

SEQ ID NO: 720 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCEHWAQLCAAIA

SEQ ID NO: 721 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCEHWAQLCAAIA

SEQ ID NO: 722 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCEHWAQLCAAWA

SEQ ID NO: 723 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCEHWAQLCAAWA

SEQ ID NO: 724 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCEHWAQLCAALA

SEQ ID NO: 725 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCEHWAQLCAALA

SEQ ID NO: 726 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
ETFCEHWVQLCAALA

SEQ ID NO: 727 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAYWAQLCAAAA

SEQ ID NO: 728 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAYWAQLCAAAA

SEQ ID NO: 729 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): 2-aminoisobutyric acid
  C-term NH2
LTFCAYWAQLCAAXA

SEQ ID NO: 730 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): 2-aminoisobutyric acid
  C-term NH2
LTFCAYWAQLCAAXA

SEQ ID NO: 731 - protein, 16 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (16)..(16): D-amino acid
  C-term NH2
LTFCAYWAQLCAAAAA

SEQ ID NO: 732 - protein, 15 aa, Artificial Sequence
  Description of Artificial Sequence: Synthetic peptide
  N-term Ac
  MOD_RES (4)..(4): Alpha-methyl-L-cysteine connected by an i to i+7, seven-methylene crosslinker to another thiol-containing amino acidr5
  misc_feature (4)..(11): Crosslink between residues
  MOD_RES (11)..(11): Alpha-methyl-L-cysteine connected by an i to i+7, seven-methylene crosslinker to another thiol-containing amino acids8
  MOD_RES (15)..(15): D-amino acid
  C-term NH2
LTFCAYWAQLCAAIA

SEQ ID NO: 733 - protein, 14 aa, Artificial Sequence
  Description of Artificial Sequence: Synthetic peptide
  N-term Ac
  MOD_RES (4)..(4): Alpha-methyl-L-cysteine connected by an i to i+7, seven-methylene crosslinker to another thiol-containing amino acidr5
  misc_feature (4)..(11): Crosslink between residues
  MOD_RES (11)..(11): Alpha-methyl-L-cysteine connected by an i to i+7, seven-methylene crosslinker to another thiol-containing amino acids8
  C-term NH2
LTFCAYWAQLCSAA

SEQ ID NO: 734 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAYWAQACAALA

SEQ ID NO: 735 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
ETFCAYWAQACAALA

SEQ ID NO: 736 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCEYWAQACAALA

SEQ ID NO: 737 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAYWAQACAWLA

SEQ ID NO: 738 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
ETFCAYWAQACAWLA

SEQ ID NO: 739 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCEYWAQACAWLA

SEQ ID NO: 740 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCEYWAQACSAFA

SEQ ID NO: 741 - protein, 15 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCEYWAQACSALA

SEQ ID NO: 742 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (6)..(6): 4-carboxy-Phe
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCEFWAQACSALA

SEQ ID NO: 743 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCEYWSQACSALA

SEQ ID NO: 744 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCEYWWQACSALA

SEQ ID NO: 745 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCEYWAQACAAIA

SEQ ID NO: 746 - protein, 15 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCEYWAQACAAIA

SEQ ID NO: 747 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (6)..(6): 4-carboxy-Phe
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCEFWAQACAAIA

SEQ ID NO: 748 - protein, 14 aa, Artificial Sequence
  Description of Artificial Sequence: Synthetic peptide
  N-term Pam
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
ETFCEYWAQACSAA

SEQ ID NO: 749 - protein, 14 aa, Artificial Sequence
  Description of Artificial Sequence: Synthetic peptide
  N-term Ac
  MOD_RES (3)..(3): homo-Phe
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCEFWAQACSAA

SEQ ID NO: 750 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTACEYWAQACSAA

SEQ ID NO: 751 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCEYAAQACSAA

SEQ ID NO: 752 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (7)..(7): 2Nal
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCEYAAQACSAA

SEQ ID NO: 753 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCAYWAQACSAA

SEQ ID NO: 754 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCEYWAQACSAF

SEQ ID NO: 755 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCEYWAQACSAFA

SEQ ID NO: 756 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCAYWAQACSAF

SEQ ID NO: 757 - protein, 14 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCAYWAQACSAF

SEQ ID NO: 758 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (6)..(6): 4-carboxy-Phe
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCAFWAQACSAF

SEQ ID NO: 759 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (7)..(7): 6cl-Trp
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCEYWAQACSAF

SEQ ID NO: 760 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCAYWSQACSAF

SEQ ID NO: 761 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCAYWWQACSAF

SEQ ID NO: 762 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAYWAQACAAIA

SEQ ID NO: 763 - protein, 15 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAYWAQACAAIA

SEQ ID NO: 764 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (7)..(7): 6cl-Trp
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAYWAQACAAIA

SEQ ID NO: 765 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (6)..(6): 4-carboxy-Phe
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAFWAQACAAIA

SEQ ID NO: 766 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCEYWAQACAAFA

SEQ ID NO: 767 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCEYWAQACAAFA

SEQ ID NO: 768 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (15)..(15): D-amino acid
  C-term NH2
ETFCAYWAQACAWLA

SEQ ID NO: 769 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (15)..(15): D-amino acid
  C-term NH2
LTFCEYWAQACAWLA

SEQ ID NO: 770 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (15)..(15): D-amino acid
  C-term NH2
ETFCEYWAQACAWLA

SEQ ID NO: 771 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (15)..(15): D-amino acid
  C-term NH2
ETFCEYWAQACAWLA

SEQ ID NO: 772 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAYWAQACSAFA

SEQ ID NO: 773 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCAYWAQACSAFA

SEQ ID NO: 774 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (15)..(15): D-amino acid
  C-term NH2
ETFCAYWAQLCAWLA

SEQ ID NO: 775 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (15)..(15): D-amino acid
  C-term NH2
LTFCEYWAQLCAWLA

SEQ ID NO: 776 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (15)..(15): D-amino acid
  C-term NH2
ETFCEYWAQLCAWLA

SEQ ID NO: 777 - protein, 14 aa, Artificial Sequence
  Description of Artificial Sequence: Synthetic peptide
  N-term Dmaac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): homo-Leu
  MOD_RES (11)..(11): Alpha-methyl-L-cysteine connected by an i to i+7, seven-methylene crosslinker to another thiol-containing amino acid
  C-term NH2
LTFCEYWAQLCSAA

SEQ ID NO: 778 - protein, 14 aa, Artificial Sequence
  Description of Artificial Sequence: Synthetic peptide
  N-term Hexac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): homo-Leu
  MOD_RES (11)..(11): Alpha-methyl-L-cysteine connected by an i to i+7, seven-methylene crosslinker to another thiol-containing amino acid
  C-term NH2
LTFCEYWAQLCSAA

SEQ ID NO: 779 - protein, 14 aa, Artificial Sequence
  Description of Artificial Sequence: Synthetic peptide
  N-term Napac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): homo-Leu
  MOD_RES (11)..(11): Alpha-methyl-L-cysteine connected by an i to i+7, seven-methylene crosslinker to another thiol-containing amino acid
  C-term NH2
LTFCEYWAQLCSAA

SEQ ID NO: 780 - protein, 14 aa, Artificial Sequence
  Description of Artificial Sequence: Synthetic peptide
  N-term Decac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): homo-Leu
  MOD_RES (11)..(11): Alpha-methyl-L-cysteine connected by an i to i+7, seven-methylene crosslinker to another thiol-containing amino acid
  C-term NH2
LTFCEYWAQLCSAA

SEQ ID NO: 781 - protein, 14 aa, Artificial Sequence
  Description of Artificial Sequence: Synthetic peptide
  N-term Admac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): homo-Leu
  MOD_RES (11)..(11): Alpha-methyl-L-cysteine connected by an i to i+7, seven-methylene crosslinker to another thiol-containing amino acid
  C-term NH2
LTFCEYWAQLCSAA

SEQ ID NO: 782 - protein, 14 aa, Artificial Sequence
  Description of Artificial Sequence: Synthetic peptide
  N-term Tmac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): homo-Leu
  MOD_RES (11)..(11): Alpha-methyl-L-cysteine connected by an i to i+7, seven-methylene crosslinker to another thiol-containing amino acid
  C-term NH2
LTFCEYWAQLCSAA

SEQ ID NO: 783 - protein, 14 aa, Artificial Sequence
  Description of Artificial Sequence: Synthetic peptide
  N-term Pam
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): homo-Leu
  MOD_RES (11)..(11): Alpha-methyl-L-cysteine connected by an i to i+7, seven-methylene crosslinker to another thiol-containing amino acid
  C-term NH2
LTFCEYWAQLCSAA

SEQ ID NO: 784 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAYWAQACAALA

SEQ ID NO: 785 - protein, 15 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCEYWAQACAAIA

SEQ ID NO: 786 - protein, 14 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCEYWAQACSAA

SEQ ID NO: 787 - protein, 14 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCEYWAQACSAA

SEQ ID NO: 788 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (6)..(6): 4-carboxy-Phe
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCEFWAQACSAA

SEQ ID NO: 789 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (6)..(6): 4-carboxy-Phe
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCEFWAQACSAA

SEQ ID NO: 790 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCEYWSQACSAA

SEQ ID NO: 791 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCEYWSQACSAA

SEQ ID NO: 792 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): homo-Leu
  MOD_RES (11)..(11): Alpha-methyl-L-cysteine connected by an i to i+7, seven-methylene crosslinker to another thiol-containing amino acid
  C-term NH2
LTFCEYWAQLCSAA

SEQ ID NO: 793 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): homo-Leu
  MOD_RES (11)..(11): Alpha-methyl-L-cysteine connected by an i to i+7, seven-methylene crosslinker to another thiol-containing amino acid
  C-term NH2
LTFCAYWAQLCSAF

SEQ ID NO: 794 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): homo-Leu
  MOD_RES (11)..(11): Alpha-methyl-L-cysteine connected by an i to i+7, seven-methylene crosslinker to another thiol-containing amino acid
  C-term NH2
LTFCAYWAQLCSAF

SEQ ID NO: 795 - protein, 14 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): homo-Leu
  MOD_RES (11)..(11): Alpha-methyl-L-cysteine connected by an i to i+7, seven-methylene crosslinker to another thiol-containing amino acid
  C-term NH2
LTFCAYWAQLCSAA

SEQ ID NO: 796 - protein, 14 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): homo-Leu
  MOD_RES (11)..(11): Alpha-methyl-L-cysteine connected by an i to i+7, seven-methylene crosslinker to another thiol-containing amino acid
  C-term NH2
LTFCAYWAQLCSAA

SEQ ID NO: 797 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (6)..(6): 4-carboxy-Phe
  MOD_RES (10)..(10): homo-Leu
  MOD_RES (11)..(11): Alpha-methyl-L-cysteine connected by an i to i+7, seven-methylene crosslinker to another thiol-containing amino acid
  C-term NH2
LTFCAFWAQLCSAA

SEQ ID NO: 798 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (6)..(6): 4-carboxy-Phe
  MOD_RES (10)..(10): homo-Leu
  MOD_RES (11)..(11): Alpha-methyl-L-cysteine connected by an i to i+7, seven-methylene crosslinker to another thiol-containing amino acid
  C-term NH2
LTFCAFWAQLCSAA

SEQ ID NO: 799 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): homo-Leu
  MOD_RES (11)..(11): Alpha-methyl-L-cysteine connected by an i to i+7, seven-methylene crosslinker to another thiol-containing amino acid
  C-term NH2
LTFCAYWSQLCSAA

SEQ ID NO: 800 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): homo-Leu
  MOD_RES (11)..(11): Alpha-methyl-L-cysteine connected by an i to i+7, seven-methylene crosslinker to another thiol-containing amino acid
  C-term NH2
LTFCAYWSQLCSAA

SEQ ID NO: 801 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCEYWAQLCAALA

SEQ ID NO: 802 - protein, 15 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAYWAQLCAALA

SEQ ID NO: 803 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (6)..(6): 4-carboxy-Phe
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAFWAQLCAALA

SEQ ID NO: 804 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAYWSQLCAALA

SEQ ID NO: 805 - protein, 15 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): homo-Leu
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAYWAQLCAALA

SEQ ID NO: 806 - protein, 15 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): homo-Leu
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAYWAQLCAALA

SEQ ID NO: 807 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (6)..(6): 4-carboxy-Phe
  MOD_RES (10)..(10): homo-Leu
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAFWAQLCAALA

SEQ ID NO: 808 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (6)..(6): 4-carboxy-Phe
  MOD_RES (10)..(10): homo-Leu
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAFWAQLCAALA

SEQ ID NO: 809 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): homo-Leu
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAYWSQLCAALA

SEQ ID NO: 810 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): homo-Leu
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAYWSQLCAALA

SEQ ID NO: 811 - protein, 16 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): homo-Leu
  MOD_RES (11)..(11): Alpha-methyl-L-cysteine connected by an i to i+7, seven-methylene crosslinker to another thiol-containing amino acid
  MOD_RES (16)..(16): D-amino acid
  C-term NH2
LTFCAYWAQLCAAAAA

SEQ ID NO: 812 - protein, 16 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): homo-Leu
  MOD_RES (11)..(11): Alpha-methyl-L-cysteine connected by an i to i+7, seven-methylene crosslinker to another thiol-containing amino acid
  MOD_RES (16)..(16): D-amino acid
  C-term NH2
LTFCAYWAQLCAAAAA

SEQ ID NO: 813 - protein, 17 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (17)..(17): D-amino acid
  C-term NH2
LTFCAYWAQLCAAAAAA

SEQ ID NO: 814 - protein, 18 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (18)..(18): D-amino acid
  C-term NH2
LTFCAYWAQLCAAAAAAA

SEQ ID NO: 815 - protein, 18 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (18)..(18): D-amino acid
  C-term NH2
LTFCAYWAQLCAAAAAAA

SEQ ID NO: 816 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): homo-Leu
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCEYWAQLCAALA

SEQ ID NO: 817 - protein, 16 aa, Artificial Sequence
  Description of Artificial Sequence: Synthetic peptide
  N-term Ac
  MOD_RES (5)..(5): Alpha-methyl-D-cysteine connected by an i to i+7, seven-methylene crosslinker to another thiol-containing amino acid
  misc_feature (5)..(12): Crosslink between residues
  MOD_RES (12)..(12): Alpha-methyl-L-cysteine connected by an i to i+7, seven-methylene crosslinker to another thiol-containing amino acid
  MOD_RES (15)..(15): Norleucine
  C-term NH2
AATFCAYWAQLCAALA

SEQ ID NO: 818 - protein, 16 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAYWAQLCAALAA

SEQ ID NO: 819 - protein, 17 aa, Artificial Sequence
  Description of Artificial Sequence: Synthetic peptide
  N-term Ac
  MOD_RES (5)..(5): Alpha-methyl-D-cysteine connected by an i to i+7, seven-methylene crosslinker to another thiol-containing amino acid
  misc_feature (5)..(12): Crosslink between residues
  MOD_RES (12)..(12): Alpha-methyl-L-cysteine connected by an i to i+7, seven-methylene crosslinker to another thiol-containing amino acid
  MOD_RES (15)..(15): Norleucine
  C-term NH2
ALTFCAYWAQLCAALAA

SEQ ID NO: 820 - protein, 16 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAYWAQACAALAA

SEQ ID NO: 821 - protein, 16 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): homo-Leu
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAYWAQLCAALAA

SEQ ID NO: 822 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCEYWAQACSAAA

SEQ ID NO: 823 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCEYWAQACSAAA

SEQ ID NO: 824 - protein, 16 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCEYWAQACSAAAA

SEQ ID NO: 825 - protein, 16 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCEYWAQACSAAAA

SEQ ID NO: 826 - protein, 15 aa, Artificial Sequence
  Description of Artificial Sequence: Synthetic peptide
  N-term Ac
  MOD_RES (5)..(5): Alpha-methyl-D-cysteine connected by an i to i+7, seven-methylene crosslinker to another thiol-containing amino acid
  misc_feature (5)..(12): Crosslink between residues
  MOD_RES (11)..(11): Cyclobutyl-Ala
  MOD_RES (12)..(12): Alpha-methyl-L-cysteine connected by an i to i+7, seven-methylene crosslinker to another thiol-containing amino acid
  C-term NH2
ALTFCEYWAQACSAA

SEQ ID NO: 827 - protein, 16 aa, Artificial Sequence
  Description of Artificial Sequence: Synthetic peptide
  N-term Ac
  MOD_RES (5)..(5): Alpha-methyl-D-cysteine connected by an i to i+7, seven-methylene crosslinker to another thiol-containing amino acid
  misc_feature (5)..(12): Crosslink between residues
  MOD_RES (11)..(11): Cyclobutyl-Ala
  MOD_RES (12)..(12): Alpha-methyl-L-cysteine connected by an i to i+7, seven-methylene crosslinker to another thiol-containing amino acid
  C-term NH2
ALTFCEYWAQACSAAA

SEQ ID NO: 828 - protein, 15 aa, Artificial Sequence
  Description of Artificial Sequence: Synthetic peptide
  N-term Ac
  MOD_RES (5)..(5): Alpha-methyl-D-cysteine connected by an i to i+7, seven-methylene crosslinker to another thiol-containing amino acid
  misc_feature (5)..(12): Crosslink between residues
  MOD_RES (11)..(11): Cyclobutyl-Ala
  MOD_RES (12)..(12): Alpha-methyl-L-cysteine connected by an i to i+7, seven-methylene crosslinker to another thiol-containing amino acid
  C-term NH2
ALTFCEYWAQACSAA

SEQ ID NO: 829 - protein, 17 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (17)..(17): D-amino acid
  C-term NH2
LTFCEYWAQLCAAAAAA

SEQ ID NO: 830 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (7)..(7): 6cl-Trp
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCEYWAQACSAA

SEQ ID NO: 831 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (6)..(6): 4-carboxy-Phe
  MOD_RES (7)..(7): 6cl-Trp
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCEFWAQACSALA

SEQ ID NO: 832 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (6)..(6): 4-carboxy-Phe
  MOD_RES (7)..(7): 6cl-Trp
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCEFWAQACSALA

SEQ ID NO: 833 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (6)..(6): 4-carboxy-Phe
  MOD_RES (7)..(7): 6cl-Trp
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCEFWAQACAAIA

SEQ ID NO: 834 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (6)..(6): 4-carboxy-Phe
  MOD_RES (7)..(7): 6cl-Trp
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCEFWAQACAAIA

SEQ ID NO: 835 - protein, 17 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (7)..(7): 6cl-Trp
  MOD_RES (11)..(11): Alpha-methyl-L-cysteine connected by an i to i+7, seven-methylene crosslinker to another thiol-containing amino acid
  MOD_RES (17)..(17): D-amino acid
  C-term NH2
LTFCAYWAQLCAAAAAA

SEQ ID NO: 836 - protein, 17 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (7)..(7): 6cl-Trp
  MOD_RES (11)..(11): Alpha-methyl-L-cysteine connected by an i to i+7, seven-methylene crosslinker to another thiol-containing amino acid
  MOD_RES (17)..(17): D-amino acid
  C-term NH2
LTFCAYWAQLCAAAAAA

SEQ ID NO: 837 - protein, 16 aa, Artificial Sequence
  Description of Artificial Sequence: Synthetic peptide
  N-term Ac
  MOD_RES (2)..(2): Alpha-methyl-D-cysteine connected by an i to i+7, seven-methylene crosslinker to another thiol-containing amino acid
  misc_feature (2)..(9): Crosslink between residues
  MOD_RES (5)..(5): 6cl-Trp
  MOD_RES (9)..(9): Alpha-methyl-L-cysteine connected by an i to i+7, seven-methylene crosslinker to another thiol-containing amino acid
  MOD_RES (16)..(16): D-amino acid
  C-term NH2
FCAYWEALCAAAAAAA

SEQ ID NO: 838 - protein, 17 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (17)..(17): D-amino acid
  C-term NH2
ETFCEYWAQLCAAAAAA

SEQ ID NO: 839 - protein, 17 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (17)..(17): D-amino acid
  C-term NH2
ETFCEYWAQLCAAAAAA

SEQ ID NO: 840 - protein, 18 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (18)..(18): D-amino acid
  C-term NH2
LTFCEYWAQLCAAAAAAA

SEQ ID NO: 841 - protein, 18 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (18)..(18): D-amino acid
  C-term NH2
LTFCEYWAQLCAAAAAAA

SEQ ID NO: 842 - protein, 17 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (17)..(17): D-amino acid
  C-term NH2
LTFCAYWAQLCAALAAA

SEQ ID NO: 843 - protein, 17 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (17)..(17): D-amino acid
  C-term NH2
LTFCAYWAQLCAALAAA

SEQ ID NO: 844 - protein, 17 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (17)..(17): D-amino acid
  C-term NH2
LTFCEYWAQACAAAAAA

SEQ ID NO: 845 - protein, 17 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (17)..(17): D-amino acid
  C-term NH2
LTFCEYWAQACAAAAAA

SEQ ID NO: 846 - protein, 17 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (6)..(6): 4-carboxy-Phe
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (17)..(17): D-amino acid
  C-term NH2
LTFCEFWAQACAAAAAA

SEQ ID NO: 847 - protein, 17 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (6)..(6): 4-carboxy-Phe
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (17)..(17): D-amino acid
  C-term NH2
LTFCEFWAQACAAAAAA

SEQ ID NO: 848 - protein, 17 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (17)..(17): D-amino acid
  C-term NH2
LTFCEYWSQACAAAAAA

SEQ ID NO: 849 - protein, 17 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (17)..(17): D-amino acid
  C-term NH2
LTFCEYWSQACAAAAAA

SEQ ID NO: 850 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCEYWAQACSAAA

SEQ ID NO: 851 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCEYWAQACSAAA

SEQ ID NO: 852 - protein, 16 aa, Artificial Sequence
  Description of Artificial Sequence: Synthetic peptide
  N-term Ac
  MOD_RES (5)..(5): Alpha-methyl-D-cysteine connected by an i to i+7, seven-methylene crosslinker to another thiol-containing amino acid
  misc_feature (5)..(12): Crosslink between residues
  MOD_RES (11)..(11): Cyclobutyl-Ala
  MOD_RES (12)..(12): Alpha-methyl-L-cysteine connected by an i to i+7, seven-methylene crosslinker to another thiol-containing amino acid
  MOD_RES (16)..(16): D-amino acid
  C-term NH2
ALTFCEYWAQACSAAA

SEQ ID NO: 853 - protein, 16 aa, Artificial Sequence
  Description of Artificial Sequence: Synthetic peptide
  N-term Ac
  MOD_RES (5)..(5): Alpha-methyl-D-cysteine connected by an i to i+7, seven-methylene crosslinker to another thiol-containing amino acid
  misc_feature (5)..(12): Crosslink between residues
  MOD_RES (11)..(11): Cyclobutyl-Ala
  MOD_RES (12)..(12): Alpha-methyl-L-cysteine connected by an i to i+7, seven-methylene crosslinker to another thiol-containing amino acid
  MOD_RES (16)..(16): D-amino acid
  C-term NH2
ALTFCEYWAQACSAAA

SEQ ID NO: 854 - protein, 17 aa, Artificial Sequence
  Description of Artificial Sequence: Synthetic peptide
  N-term Ac
  MOD_RES (5)..(5): Alpha-methyl-D-cysteine connected by an i to i+7, seven-methylene crosslinker to another thiol-containing amino acid
  misc_feature (5)..(12): Crosslink between residues
  MOD_RES (11)..(11): Cyclobutyl-Ala
  MOD_RES (12)..(12): Alpha-methyl-L-cysteine connected by an i to i+7, seven-methylene crosslinker to another thiol-containing amino acid
  MOD_RES (17)..(17): D-amino acid
  C-term NH2
ALTFCEYWAQACSAAAA

SEQ ID NO: 855 - protein, 17 aa, Artificial Sequence
  Description of Artificial Sequence: Synthetic peptide
  N-term Ac
  MOD_RES (5)..(5): Alpha-methyl-D-cysteine connected by an i to i+7, seven-methylene crosslinker to another thiol-containing amino acid
  misc_feature (5)..(12): Crosslink between residues
  MOD_RES (11)..(11): Cyclobutyl-Ala
  MOD_RES (12)..(12): Alpha-methyl-L-cysteine connected by an i to i+7, seven-methylene crosslinker to another thiol-containing amino acid
  MOD_RES (17)..(17): D-amino acid
  C-term NH2
ALTFCEYWAQACSAAAA

SEQ ID NO: 856 - protein, 18 aa, Artificial Sequence
  Description of Artificial Sequence: Synthetic peptide
  N-term Ac
  MOD_RES (6)..(6): Alpha-methyl-D-cysteine connected by an i to i+7, seven-methylene crosslinker to another thiol-containing amino acid
  misc_feature (6)..(13): Crosslink between residues
  MOD_RES (12)..(12): Cyclobutyl-Ala
  MOD_RES (13)..(13): Alpha-methyl-L-cysteine connected by an i to i+7, seven-methylene crosslinker to another thiol-containing amino acid
  MOD_RES (18)..(18): D-amino acid
  C-term NH2
AALTFCEYWAQACSAAAA

SEQ ID NO: 857 - protein, 18 aa, Artificial Sequence
  Description of Artificial Sequence: Synthetic peptide
  N-term Ac
  MOD_RES (6)..(6): Alpha-methyl-D-cysteine connected by an i to i+7, seven-methylene crosslinker to another thiol-containing amino acid
  misc_feature (6)..(13): Crosslink between residues
  MOD_RES (12)..(12): Cyclobutyl-Ala
  MOD_RES (13)..(13): Alpha-methyl-L-cysteine connected by an i to i+7, seven-methylene crosslinker to another thiol-containing amino acid
  MOD_RES (18)..(18): D-amino acid
  C-term NH2
AALTFCEYWAQACSAAAA

SEQ ID NO: 858 - protein, 14 aa, Artificial Sequence
  Description of Artificial Sequence: Synthetic peptide
  N-term Ac
  MOD_RES (5)..(5): Alpha-methyl-D-cysteine connected by an i to i+7, seven-methylene crosslinker to another thiol-containing amino acid
  misc_feature (5)..(12): Crosslink between residues
  MOD_RES (11)..(11): Cyclobutyl-Ala
  MOD_RES (12)..(12): Alpha-methyl-L-cysteine connected by an i to i+7, seven-methylene crosslinker to another thiol-containing amino acid
  C-term NH2
RTFCEYWAQACSAA

SEQ ID NO: 859 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LRFCEYWAQACSAA

SEQ ID NO: 860 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCEYWRQACSAA

SEQ ID NO: 861 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCEYWARACSAA

SEQ ID NO: 862 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCEYWAQACRAA

SEQ ID NO: 863 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCEYWAQACSRA

SEQ ID NO: 864 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCEYWAQACSAR

SEQ ID NO: 865 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-methyl-D-cysteine connected by an i to i+7, seven-methylene crosslinker to another thiol-containing amino acid
  misc_feature (5)..(12): Crosslink between residues
  MOD_RES (11)..(11): Cyclobutyl-Ala
  MOD_RES (12)..(12): Alpha-methyl-L-cysteine connected by an i to i+7, seven-methylene crosslinker to another thiol-containing amino acid
  C-term NH2
ALTFCEYWAQACSAA

SEQ ID NO: 866 - protein, 16 aa, Artificial Sequence
  Description of Artificial Sequence: Synthetic peptide
  N-term 5-FAM
  MOD_RES (1)..(1): Beta-Ala
  MOD_RES (5)..(5): Alpha-methyl-D-cysteine connected by an i to i+7, seven-methylene crosslinker to another thiol-containing amino acid
  misc_feature (5)..(12): Crosslink between residues
  MOD_RES (12)..(12): Alpha-methyl-L-cysteine connected by an i to i+7, seven-methylene crosslinker to another thiol-containing amino acid
  MOD_RES (15)..(15): Norleucine
  C-term NH2
ALTFCAYWAQLCAALA

SEQ ID NO: 867 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LAFCEYWAQLCAALA

SEQ ID NO: 868 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
ATFCEYWAQLCAALA

SEQ ID NO: 869 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
AAFCEYWAQLCAALA

SEQ ID NO: 870 - protein, 16 aa, Artificial Sequence
  Description of Artificial Sequence: Synthetic peptide
  N-term Ac
  MOD_RES (5)..(5): Alpha-methyl-D-cysteine connected by an i to i+7, seven-methylene crosslinker to another thiol-containing amino acid
  misc_feature (5)..(12): Crosslink between residues
  MOD_RES (12)..(12): Alpha-methyl-L-cysteine connected by an i to i+7, seven-methylene crosslinker to another thiol-containing amino acid
  MOD_RES (15)..(15): Norleucine
  C-term NH2
AAAFCEYWAQLCAALA

SEQ ID NO: 871 - protein, 17 aa, Artificial Sequence
  Description of Artificial Sequence: Synthetic peptide
  N-term Ac
  MOD_RES (6)..(6): Alpha-methyl-D-cysteine connected by an i to i+7, seven-methylene crosslinker to another thiol-containing amino acid
  misc_feature (6)..(13): Crosslink between residues
  MOD_RES (13)..(13): Alpha-methyl-L-cysteine connected by an i to i+7, seven-methylene crosslinker to another thiol-containing amino acid
  MOD_RES (16)..(16): Norleucine
  C-term NH2
AAAAFCEYWAQLCAALA

SEQ ID NO: 872 - protein, 16 aa, Artificial Sequence
  Description of Artificial Sequence: Synthetic peptide
  N-term Ac
  MOD_RES (5)..(5): Alpha-methyl-D-cysteine connected by an i to i+7, seven-methylene crosslinker to another thiol-containing amino acid
  misc_feature (5)..(12): Crosslink between residues
  MOD_RES (12)..(12): Alpha-methyl-L-cysteine connected by an i to i+7, seven-methylene crosslinker to another thiol-containing amino acid
  MOD_RES (15)..(15): Norleucine
  C-term NH2
AATFCEYWAQLCAALA

SEQ ID NO: 873 - protein, 17 aa, Artificial Sequence
  Description of Artificial Sequence: Synthetic peptide
  N-term Ac
  MOD_RES (6)..(6): Alpha-methyl-D-cysteine connected by an i to i+7, seven-methylene crosslinker to another thiol-containing amino acid
  misc_feature (6)..(13): Crosslink between residues
  MOD_RES (13)..(13): Alpha-methyl-L-cysteine connected by an i to i+7, seven-methylene crosslinker to another thiol-containing amino acid
  MOD_RES (16)..(16): Norleucine
  C-term NH2
AALTFCEYWAQLCAALA

SEQ ID NO: 874 - protein, 18 aa, Artificial Sequence
  Description of Artificial Sequence: Synthetic peptide
  N-term Ac
  MOD_RES (7)..(7): Alpha-methyl-D-cysteine connected by an i to i+7, seven-methylene crosslinker to another thiol-containing amino acid
  misc_feature (7)..(14): Crosslink between residues
  MOD_RES (14)..(14): Alpha-methyl-L-cysteine connected by an i to i+7, seven-methylene crosslinker to another thiol-containing amino acid
  MOD_RES (17)..(17): Norleucine
  C-term NH2
AAALTFCEYWAQLCAALA

SEQ ID NO: 875 - protein, 16 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCEYWAQLCAALAA

SEQ ID NO: 876 - protein, 17 aa, Artificial Sequence
  Description of Artificial Sequence: Synthetic peptide
  N-term Ac
  MOD_RES (5)..(5): Alpha-methyl-D-cysteine connected by an i to i+7, seven-methylene crosslinker to another thiol-containing amino acid
  misc_feature (5)..(12): Crosslink between residues
  MOD_RES (12)..(12): Alpha-methyl-L-cysteine connected by an i to i+7, seven-methylene crosslinker to another thiol-containing amino acid
  MOD_RES (15)..(15): Norleucine
  C-term NH2
ALTFCEYWAQLCAALAA

SEQ ID NO: 877 - protein, 18 aa, Artificial Sequence
  Description of Artificial Sequence: Synthetic peptide
  N-term Ac
  MOD_RES (6)..(6): Alpha-methyl-D-cysteine connected by an i to i+7, seven-methylene crosslinker to another thiol-containing amino acid
  misc_feature (6)..(13): Crosslink between residues
  MOD_RES (13)..(13): Alpha-methyl-L-cysteine connected by an i to i+7, seven-methylene crosslinker to another thiol-containing amino acid
  MOD_RES (16)..(16): Norleucine
  C-term NH2
AALTFCEYWAQLCAALAA

SEQ ID NO: 878 - protein, 16 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCEYWAQACAALAA

SEQ ID NO: 879 - protein, 16 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): homo-Leu
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCEYWAQLCAALAA

SEQ ID NO: 880 - protein, 17 aa, Artificial Sequence
  Description of Artificial Sequence: Synthetic peptide
  N-term Ac
  MOD_RES (5)..(5): Alpha-methyl-D-cysteine connected by an i to i+7, seven-methylene crosslinker to another thiol-containing amino acid
  misc_feature (5)..(12): Crosslink between residues
  MOD_RES (11)..(11): homo-Leu
  MOD_RES (12)..(12): Alpha-methyl-L-cysteine connected by an i to i+7, seven-methylene crosslinker to another thiol-containing amino acid
  MOD_RES (15)..(15): Norleucine
  C-term NH2
ALTFCEYWAQLCAALAA

SEQ ID NO: 881 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (6)..(6): N-methyl-Tyr
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAYWAQLCAALA

SEQ ID NO: 882 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (6)..(6): N-methyl-Tyr
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAYWAQLCAALA

SEQ ID NO: 883 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (7)..(7): N-methyl-Trp
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAYWAQLCAALA

SEQ ID NO: 884 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (7)..(7): N-methyl-Trp
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAYWAQLCAALA

SEQ ID NO: 885 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (7)..(7): Alpha-Me-Trp
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAYWAQLCAALA

SEQ ID NO: 886 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (7)..(7): Alpha-Me-Trp
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAYWAQLCAALA

SEQ ID NO: 887 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (8)..(8): 2-aminoisobutyric acid
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAYWXQLCAALA

SEQ ID NO: 888 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (8)..(8): 2-aminoisobutyric acid
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAYWXQLCAALA

SEQ ID NO: 889 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (13)..(13): 2-aminoisobutyric acid
  MOD_RES (14)..(14): Norleucine
  C-term NH2
LTFCAYWAQLCAXLA

SEQ ID NO: 890 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (13)..(13): 2-aminoisobutyric acid
  MOD_RES (14)..(14): Norleucine
  C-term NH2
LTFCAYWAQLCAXLA

SEQ ID NO: 891 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (13)..(13): D-amino acid
  MOD_RES (14)..(14): Norleucine
  C-term NH2
LTFCAYWAQLCAALA

SEQ ID NO: 892 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (13)..(13): D-amino acid
  MOD_RES (14)..(14): Norleucine
  C-term NH2
LTFCAYWAQLCAALA

SEQ ID NO: 893 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (13)..(13): Sarcosine
  MOD_RES (14)..(14): Norleucine
  C-term NH2
LTFCAYWAQLCAXLA

SEQ ID NO: 894 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (13)..(13): Sarcosine
  MOD_RES (14)..(14): Norleucine
  C-term NH2
LTFCAYWAQLCAXLA

SEQ ID NO: 895 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (15)..(15): 2-aminoisobutyric acid
  C-term NH2
LTFCAYWAQLCAALX

SEQ ID NO: 896 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (15)..(15): 2-aminoisobutyric acid
  C-term NH2
LTFCAYWAQLCAALX

SEQ ID NO: 897 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (15)..(15): N-methyl-Ala
  C-term NH2
LTFCAYWAQLCAALA

SEQ ID NO: 898 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (15)..(15): N-methyl-Ala
  C-term NH2
LTFCAYWAQLCAALA

SEQ ID NO: 899 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (15)..(15): Sarcosine
  C-term NH2
LTFCAYWAQLCAALX

SEQ ID NO: 900 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (15)..(15): Sarcosine
  C-term NH2
LTFCAYWAQLCAALX

SEQ ID NO: 901 - protein, 16 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (16)..(16): 2-aminoisobutyric acid
  C-term NH2
LTFCAYWAQLCAALAX

SEQ ID NO: 902 - protein, 16 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (16)..(16): 2-aminoisobutyric acid
  C-term NH2
LTFCAYWAQLCAALAX

SEQ ID NO: 903 - protein, 16 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (16)..(16): N-methyl-Ala
  C-term NH2
LTFCAYWAQLCAALAA

SEQ ID NO: 904 - protein, 16 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (16)..(16): N-methyl-Ala
  C-term NH2
LTFCAYWAQLCAALAA

SEQ ID NO: 905 - protein, 16 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (16)..(16): D-amino acid
  C-term NH2
LTFCAYWAQLCAALAA

SEQ ID NO: 906 - protein, 16 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (16)..(16): D-amino acid
  C-term NH2
LTFCAYWAQLCAALAA

SEQ ID NO: 907 - protein, 16 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (16)..(16): Sarcosine
  C-term NH2
LTFCAYWAQLCAALAX

SEQ ID NO: 908 - protein, 16 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  MOD_RES (16)..(16): Sarcosine
  C-term NH2
LTFCAYWAQLCAALAX

SEQ ID NO: 909 - protein, 15 aa, Artificial Sequence
  Description of Artificial Sequence: Synthetic peptide
  N-term Ac
  MOD_RES (4)..(4): Alpha-methyl-R8-L-cysteine not connected by an i to i+7, seven-methylene crosslinker to another thiol-containing amino acid
  MOD_RES (11)..(11): Alpha-methyl-L-cysteine not connected by a i to i+7, seven-methylene crosslinker to another thiol-containing amino acid
  MOD_RES (14)..(14): Norleucine
  C-term NH2
LTFCAYWAQLCAALA

SEQ ID NO: 910 - protein, 15 aa, Artificial Sequence
  Description of Artificial Sequence: Synthetic peptide
  N-term Ac
  MOD_RES (4)..(4): 2-aminoisobutyric acid
  MOD_RES (11)..(11): 2-aminoisobutyric acid
  MOD_RES (14)..(14): Norleucine
  C-term NH2
LTFXAYWAQLXAALA

SEQ ID NO: 911 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (5)..(5): Cou4
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCXYWAQLCAALA

SEQ ID NO: 912 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (5)..(5): Cou4
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCXYWAQLCAALA

SEQ ID NO: 913 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (8)..(8): Cou4
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAYWXQLCAALA

SEQ ID NO: 914 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (12)..(12): Cou4
  MOD_RES (14)..(14): Norleucine
  C-term NH2
LTFCAYWAQLCXALA

SEQ ID NO: 915 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (12)..(12): Cou4
  MOD_RES (14)..(14): Norleucine
  C-term NH2
LTFCAYWAQLCXALA

SEQ ID NO: 916 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (13)..(13): Cou4
  MOD_RES (14)..(14): Norleucine
  C-term NH2
LTFCAYWAQLCAXLA

SEQ ID NO: 917 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (13)..(13): Cou4
  MOD_RES (14)..(14): Norleucine
  C-term NH2
LTFCAYWAQLCAXLA

SEQ ID NO: 918 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  C-term OH
LTFCAYWAQLCAALA

SEQ ID NO: 919 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  C-term OH
LTFCAYWAQLCAALA

SEQ ID NO: 920 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  C-term NHnPr
LTFCAYWAQLCAALA

SEQ ID NO: 921 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  C-term NHnPr
LTFCAYWAQLCAALA

SEQ ID NO: 922 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  C-term NHnBu33Me
LTFCAYWAQLCAALA

SEQ ID NO: 923 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  C-term NHnBu33Me
LTFCAYWAQLCAALA

SEQ ID NO: 924 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  C-term NHHex
LTFCAYWAQLCAALA

SEQ ID NO: 925 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  C-term NHHex
LTFCAYWAQLCAALA

SEQ ID NO: 926 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTACAYWAQLCAALA

SEQ ID NO: 927 - protein, 15 aa, Artificial Sequence
  Description of Artificial Sequence: Synthetic peptide
  N-term Ac
  MOD_RES (3)..(3): homo-Leu
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTLCAYWAQLCAALA

SEQ ID NO: 928 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAYAAQLCAALA

SEQ ID NO: 929 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (7)..(7): 2Nal
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAYAAQLCAALA

SEQ ID NO: 930 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (8)..(8): Cou4
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCEYWXQACSAA

SEQ ID NO: 931 - protein, 14 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (8)..(8): Cou7
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCEYWXQACSAA

SEQ ID NO: 932 - protein, 14 aa, Artificial Sequence
  Description of Artificial Sequence: Synthetic peptide
  N-term Dmaac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  C-term NH2
LTFCEYWAQACSAA

SEQ ID NO: 933 - protein, 17 aa, Artificial Sequence
  Description of Artificial Sequence: Synthetic peptide
  N-term Dmaac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (17)..(17): D-amino acid
  C-term NH2
LTFCAYWAQLCAAAAAA

SEQ ID NO: 934 - protein, 17 aa, Artificial Sequence
  Description of Artificial Sequence: Synthetic peptide
  N-term Dmaac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (17)..(17): D-amino acid
  C-term NH2
LTFCAYWAQLCAAAAAA

SEQ ID NO: 935 - protein, 17 aa, Artificial Sequence
  Description of Artificial Sequence: Synthetic peptide
  N-term Dmaac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (17)..(17): D-amino acid
  C-term NH2
LTFCEYWAQLCAAAAAA

SEQ ID NO: 936 - protein, 17 aa, Artificial Sequence
  Description of Artificial Sequence: Synthetic peptide
  N-term Dmaac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (17)..(17): D-amino acid
  C-term NH2
LTFCEYWAQLCAAAAAA

SEQ ID NO: 937 - protein, 15 aa, Artificial Sequence
  Description of Artificial Sequence: Synthetic peptide
  N-term Dmaac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (6)..(6): 4-carboxy-Phe
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCEFWAQACAAIA

SEQ ID NO: 938 - protein, 15 aa, Artificial Sequence
  Description of Artificial Sequence: Synthetic peptide
  N-term Dmaac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (6)..(6): 4-carboxy-Phe
  MOD_RES (10)..(10): Cyclobutyl-Ala
  MOD_RES (11)..(11): Alpha-methyl-L-cysteine connected by an i to i+7, seven-methylene crosslinker to another thiol-containing amino acid
  MOD_RES (15)..(15): D-amino acid
  C-term NH2
LTFCEFWAQACAAIA

SEQ ID NO: 939 - protein, 15 aa, Artificial Sequence
  Description of Artificial Sequence: Synthetic peptide
  N-term Dmaac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAYWAQLCAALA

SEQ ID NO: 940 - protein, 15 aa, Artificial Sequence
  Description of Artificial Sequence: Synthetic peptide
  N-term Dmaac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAYWAQLCAALA

SEQ ID NO: 941 - protein, 16 aa, Artificial Sequence
  Description of Artificial Sequence: Synthetic peptide
  MOD_RES (1)..(1): Cou6
  MOD_RES (2)..(2): Beta-Ala
  MOD_RES (6)..(6): Alpha-methyl-D-cysteine connected by an i to i+7, seven-methylene crosslinker to another thiol-containing amino acid
  misc_feature (6)..(13): Crosslink between residues
  MOD_RES (12)..(12): homo-Leu
  MOD_RES (13)..(13): Alpha-methyl-L-cysteine connected by an i to i+7, seven-methylene crosslinker to another thiol-containing amino acid
  C-term NH2
XALTFCEYWAQLCSAA

SEQ ID NO: 942 - protein, 16 aa, Artificial Sequence
  Description of Artificial Sequence: Synthetic peptide
  MOD_RES (1)..(1): Cou8
  MOD_RES (2)..(2): Beta-Ala
  MOD_RES (6)..(6): Alpha-methyl-D-cysteine connected by an i to i+7, seven-methylene crosslinker to another thiol-containing amino acid
  misc_feature (6)..(13): Crosslink between residues
  MOD_RES (12)..(12): homo-Leu
  MOD_RES (13)..(13): Alpha-methyl-L-cysteine connected by an i to i+7, seven-methylene crosslinker to another thiol-containing amino acid
  C-term NH2
XALTFCEYWAQLCSAA

SEQ ID NO: 943 - protein, 17 aa, Artificial Sequence
  Description of Artificial Sequence: Synthetic peptide
  N-term Ac
  MOD_RES (3)..(3): 4-iodo-Phe
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (17)..(17): D-amino acid
  C-term NH2
LTFCEYWAQLCAAAAAA

SEQ ID NO: 944 - protein, 15 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (14)..(14): Norleucine
  C-term NH2
LTFCAYWAQLCAALA

SEQ ID NO: 945 - protein, 17 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  MOD_RES (17)..(17): D-amino acid
  C-term NH2
LTFCAYWAQLCAAAAAA

SEQ ID NO: 946 - protein, 15 aa, Artificial Sequence
  Description of Artificial Sequence: Synthetic peptide
  N-term Ac
  MOD_RES (4)..(4): Alpha-methyl-D-cysteine connected by an i to i+7, Bph (4,4'-bismethyl-biphenyl) crosslinker to another thiol-containing amino acid
  misc_feature (4)..(11): Crosslink between residues
  MOD_RES (11)..(11): Alpha-methyl-L-cysteine connected by an i to i+7, Bph (4,4'-bismethyl-biphenyl) crosslinker to another thiol-containing amino acid
  MOD_RES (14)..(14): Norleucine
  C-term NH2
LTFCAYWAQLCAALA

SEQ ID NO: 947 - protein, 17 aa, Artificial Sequence
  Description of Artificial Sequence: Synthetic peptide
  N-term Ac
  MOD_RES (4)..(4): Alpha-methyl-D-cysteine connected by an i to i+7, Bph (4,4'-bismethyl-biphenyl) crosslinker to another thiol-containing amino acid
  misc_feature (4)..(11): Crosslink between residues
  MOD_RES (11)..(11): Alpha-methyl-L-cysteine connected by an i to i+7, Bph (4,4'-bismethyl-biphenyl) crosslinker to another thiol-containing amino acid
  MOD_RES (17)..(17): D-amino acid
  C-term NH2
LTFCAYWAQLCAAAAAA

SEQ ID NO: 948 - protein, 14 aa, Artificial Sequence
  Description of Artificial Sequence: Synthetic peptide
  N-term Ac
  MOD_RES (4)..(4): Alpha-methyl-D-cysteine connected by an i to i+7, Bph (4,4'-bismethyl-biphenyl) crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, Bph (4,4'-bismethyl-biphenyl) crosslinker to another thiol-containing amino acid
  C-term NH2
LTFCEYWAQACSAA

SEQ ID NO: 949 - protein, 14 aa, Artificial Sequence
  Description of Artificial Sequence: Synthetic peptide
  N-term Ac
  MOD_RES (4)..(4): D-cysteine connected by an i to i+7, seven- methylene crosslinker to another thiol-containing amino acid
  misc_feature (4)..(11): Crosslink between residues
  MOD_RES (10)..(10): Cyclobutyl-Ala
  MOD_RES (11)..(11): L-cysteine connected by an i to i+7, seven- methylene crosslinker to another thiol-containing amino acid
  C-term NH2
LTFCEYWAQACSAA

SEQ ID NO: 950 - protein, 14 aa, Artificial Sequence
  Description of Artificial Sequence: Synthetic peptide
  N-term Ac
  MOD_RES (4)..(4): D-cysteine connected by an i to i+7, Bph (4,4'-bismethyl-biphenyl) crosslinker to another thiol-containing amino acid
  misc_feature (4)..(11): Crosslink between residues
  MOD_RES (10)..(10): Cyclobutyl-Ala
  MOD_RES (11)..(11): L-cysteine connected by an i to i+7, Bph (4,4'-bismethyl-biphenyl) crosslinker to another thiol-containing amino acid
  C-term NH2
LTFCEYWAQACSAA

SEQ ID NO: 951 - protein, 17 aa, Artificial Sequence
  Description of Artificial Sequence: Synthetic peptide
  N-term Ac
  MOD_RES (4)..(4): Alpha-methyl-D-cysteine connected by an i to i+7, Bph (4,4'-bismethyl-biphenyl) crosslinker to another thiol-containing amino acid
  misc_feature (4)..(11): Crosslink between residues
  MOD_RES (11)..(11): Alpha-methyl-L-cysteine connected by an i to i+7, Bph (4,4'-bismethyl-biphenyl) crosslinker to another thiol-containing amino acid
  MOD_RES (17)..(17): D-amino acid
  C-term NH2
LTFCEYWAQLCAAAAAA

SEQ ID NO: 952 - protein, 15 aa, Artificial Sequence
  Description of Artificial Sequence: Synthetic peptide
  N-term Ac
  MOD_RES (4)..(4): Alpha-methyl-D-cysteine connected by an i to i+7, five-methylene crosslinker to another thiol-containing amino acid
  misc_feature (4)..(11): Crosslink between residues
  MOD_RES (11)..(11): Alpha-methyl-L-cysteine connected by an i to i+7, five-methylene crosslinker to another thiol-containing amino acid
  MOD_RES (14)..(14): Norleucine
  C-term NH2
LTFCAYWAQLCAALA

SEQ ID NO: 953 - protein, 17 aa, Artificial Sequence
  Description of Artificial Sequence: Synthetic peptide
  N-term Ac
  MOD_RES (4)..(4): Alpha-methyl-D-cysteine connected by an i to i+7, five-methylene crosslinker to another thiol-containing amino acid
  misc_feature (4)..(11): Crosslink between residues
  MOD_RES (11)..(11): Alpha-methyl-L-cysteine connected by an i to i+7, five-methylene crosslinker to another thiol-containing amino acid
  MOD_RES (17)..(17): D-amino acid
  C-term NH2
LTFCAYWAQLCAAAAAA

SEQ ID NO: 954 - protein, 15 aa, Artificial Sequence
  Description of Artificial Sequence: Synthetic peptide
  N-term Ac
  MOD_RES (4)..(4): Alpha-methyl-D-cysteine connected by an i to i+7, six-methylene crosslinker to another thiol-containing amino acid
  misc_feature (4)..(11): Crosslink between residues
  MOD_RES (11)..(11): Alpha-methyl-L-cysteine connected by an i to i+7, six-methylene crosslinker to another thiol-containing amino acid
  MOD_RES (14)..(14): Norleucine
  C-term NH2
LTFCAYWAQLCAALA

SEQ ID NO: 955 - protein, 17 aa, Artificial Sequence
  Description of Artificial Sequence: Synthetic peptide
  N-term Ac
  MOD_RES (4)..(4): Alpha-methyl-D-cysteine connected by an i to i+7, six-methylene crosslinker to another thiol-containing amino acid
  misc_feature (4)..(11): Crosslink between residues
  MOD_RES (11)..(11): Alpha-methyl-L-cysteine connected by an i to i+7, six-methylene crosslinker to another thiol-containing amino acid
  MOD_RES (17)..(17): D-amino acid
  C-term NH2
LTFCAYWAQLCAAAAAA

SEQ ID NO: 956 - protein, 17 aa, Artificial Sequence
  Description of Artificial Sequence: Synthetic peptide
  N-term Ac
  MOD_RES (4)..(4): Alpha-methyl-D-cysteine connected by an i to i+7, six-methylene crosslinker to another thiol-containing amino acid
  misc_feature (4)..(11): Crosslink between residues
  MOD_RES (11)..(11): Alpha-methyl-L-cysteine connected by an i to i+7, six-methylene crosslinker to another thiol-containing amino acid
  MOD_RES (17)..(17): D-amino acid
  C-term NH2
LTFCEYWAQLCAAAAAA

SEQ ID NO: 957 - protein, 17 aa, Artificial Sequence
  Description of Artificial Sequence: Synthetic peptide
  N-term Ac
  MOD_RES (4)..(4): Alpha-methyl-D-cysteine connected by an i to i+7, five-methylene crosslinker to another thiol-containing amino acid
  misc_feature (4)..(11): Crosslink between residues
  MOD_RES (11)..(11): Alpha-methyl-L-cysteine connected by an i to i+7, five-methylene crosslinker to another thiol-containing amino acid
  MOD_RES (17)..(17): D-amino acid
  C-term NH2
LTFCEYWAQLCAAAAAA

SEQ ID NO: 958 - protein, 14 aa, Artificial Sequence
  Description of Artificial Sequence: Synthetic peptide
  N-term Ac
  MOD_RES (4)..(4): Alpha-methyl-D-cysteine connected by an i to i+7, six-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, six-methylene crosslinker to another thiol-containing amino acid
  C-term NH2
LTFCEYWAQACSAA

SEQ ID NO: 959 - protein, 14 aa, Artificial Sequence
  Description of Artificial Sequence: Synthetic peptide
  N-term Ac
  MOD_RES (4)..(4): Alpha-methyl-D-cysteine connected by an i to i+7, five-methylene crosslinker to another thiol-containing amino acid
  misc_feature (4)..(11): Crosslink between residues
  MOD_RES (10)..(10): Cyclobutyl-Ala
  MOD_RES (11)..(11): Alpha-methyl-L-cysteine connected by an i to i+7, five-methylene crosslinker to another thiol-containing amino acid
  C-term NH2
LTFCEYWAQACSAA

SEQ ID NO: 960 - protein, 14 aa, Artificial Sequence
  Description of Artificial Sequence: Synthetic peptide
  N-term Ac
  MOD_RES (4)..(4): Any amino acid available for crosslinking
  misc_feature (4)..(11): Crosslink between residues
  MOD_RES (10)..(10): Cyclobutyl-Ala
  MOD_RES (11)..(11): Any amino acid available for crosslinking
  C-term NH2
LTFXEYWAQAXSAA

SEQ ID NO: 961 - protein, 15 aa, Artificial Sequence
  Description of Artificial Sequence: Synthetic peptide
  MOD_RES (7)..(7): Alpha-methyl-D-cysteine connected by an i to i+7, methylene crosslinker to another thiol-containing amino acid
  misc_feature (7)..(13): Crosslink between residues
  MOD_RES (13)..(13): Alpha-methyl-D-cysteine connected by an i to i+7, six-methylene crosslinker to another thiol-containing amino acid
QSQQTFCNLWLLCQN

SEQ ID NO: 962 - protein, 15 aa, Artificial Sequence
  Description of Artificial Sequence: Synthetic peptide
  MOD_RES (7)..(7): Alpha-methyl-D-cysteine connected by an i to i+7, methylene crosslinker to another thiol-containing amino acid
  misc_feature (7)..(13): Crosslink between residues
  MOD_RES (13)..(13): Alpha-methyl-D-cysteine connected by an i to i+7, seven-methylene crosslinker to another thiol-containing amino acid
QSQQTFCNLWLLCQN

SEQ ID NO: 963 - protein, 15 aa, Artificial Sequence
  Description of Artificial Sequence: Synthetic peptide
  MOD_RES (7)..(7): Alpha-methyl-D-cysteine connected by an i to i+7, methylene crosslinker to another thiol-containing amino acid
  misc_feature (7)..(13): Crosslink between residues
  MOD_RES (13)..(13): Alpha-methyl-D-cysteine connected by an i to i+7, eight-methylene crosslinker to another thiol-containing amino acid
QSQQTFCNLWLLCQN

SEQ ID NO: 964 - protein, 15 aa, Artificial Sequence
  Description of Artificial Sequence: Synthetic peptide
  MOD_RES (7)..(7): Alpha-methyl-D-cysteine connected by an i to i+7, methylene crosslinker to another thiol-containing amino acid
  misc_feature (7)..(13): Crosslink between residues
  MOD_RES (13)..(13): Alpha-methyl-D-cysteine connected by an i to i+7, nine-methylene crosslinker to another thiol-containing amino acid
QSQQTFCNLWLLCQN

SEQ ID NO: 965 - protein, 16 aa, Artificial Sequence
  Description of Artificial Sequence: Synthetic peptide
  N-term Ac
  MOD_RES (7)..(7): D-cysteine connected by an i to i+7, five-methylene crosslinker to another thiol-containing amino acid
  misc_feature (7)..(14): Crosslink between residues
  MOD_RES (14)..(14): L-cysteine connected by an i to i+7, five-methylene crosslinker to another thiol-containing amino acid
  C-term NH2
QSQQTFCNLWRLLCQN

SEQ ID NO: 966 - protein, 16 aa, Artificial Sequence
  Description of Artificial Sequence: Synthetic peptide
  N-term Ac
  MOD_RES (7)..(7): D-cysteine connected by an i to i+7, six-methylene crosslinker to another thiol-containing amino acid
  misc_feature (7)..(14): Crosslink between residues
  MOD_RES (14)..(14): L-cysteine connected by an i to i+7, six- methylene crosslinker to another thiol-containing amino acid
  C-term NH2
QSQQTFCNLWRLLCQN

SEQ ID NO: 967 - protein, 16 aa, Artificial Sequence
  Description of Artificial Sequence: Synthetic peptide
  N-term Ac
  MOD_RES (7)..(7): D-cysteine connected by an i to i+7, seven- methylene crosslinker to another thiol-containing amino acid
  misc_feature (7)..(14): Crosslink between residues
  MOD_RES (14)..(14): L-cysteine connected by an i to i+7, seven- methylene crosslinker to another thiol-containing amino acid
  C-term NH2
QSQQTFCNLWRLLCQN

SEQ ID NO: 968 - protein, 16 aa, Artificial Sequence
  Description of Artificial Sequence: Synthetic peptide
  N-term Ac
  MOD_RES (7)..(7): D-cysteine connected by an i to i+7, eight-methylene crosslinker to another thiol-containing amino acid
  misc_feature (7)..(14): Crosslink between residues
  MOD_RES (14)..(14): L-cysteine connected by an i to i+7, eight-methylene crosslinker to another thiol-containing amino acid
  C-term NH2
QSQQTFCNLWRLLCQN

SEQ ID NO: 969 - protein, 16 aa, Artificial Sequence
  Description of Artificial Sequence: Synthetic peptide
  N-term Ac
  MOD_RES (7)..(7): D-cysteine connected by an i to i+7, nine-methylene crosslinker to another thiol-containing amino acid
  misc_feature (7)..(14): Crosslink between residues
  MOD_RES (14)..(14): L-cysteine connected by an i to i+7, nine-methylene crosslinker to another thiol-containing amino acid
  C-term NH2
QSQQTFCNLWRLLCQN

SEQ ID NO: 970 - protein, 16 aa, Artificial Sequence
  Description of Artificial Sequence: Synthetic peptide
  N-term Ac
  MOD_RES (7)..(7): Alpha-methyl-D-cysteine connected by an i to i+7, eight-methylene crosslinker to another thiol-containing amino acid
  misc_feature (7)..(14): Crosslink between residues
  MOD_RES (14)..(14): Alpha-methyl-L-cysteine connected by an i to i+7, eight-methylene crosslinker to another thiol-containing amino acid
  C-term NH2
QSQQTFCNLWRLLCQN

SEQ ID NO: 971 - protein, 16 aa, Artificial Sequence
  Description of Artificial Sequence: Synthetic peptide
  N-term Ac
  MOD_RES (7)..(7): D-cysteine connected by an i to i+7, eight-methylene crosslinker to another thiol-containing amino acid
  misc_feature (7)..(14): Crosslink between residues
  MOD_RES (14)..(14): L-penicillamine connected by an i to i+7, eight-methylene crosslinker to another thiol-containing amino acid
  C-term NH2
QSQQTFCNLWRLLXQN

SEQ ID NO: 972 - protein, 16 aa, Artificial Sequence
  Description of Artificial Sequence: Synthetic peptide
  N-term Ac
  MOD_RES (7)..(7): L-cysteine connected by an i to i+7, eight-methylene crosslinker to another thiol-containing amino acid
  misc_feature (7)..(14): Crosslink between residues
  MOD_RES (14)..(14): L-cysteine connected by an i to i+7, eight-methylene crosslinker to another thiol-containing amino acid
  C-term NH2
QSQQTFCNLWRLLCQN

SEQ ID NO: 973 - protein, 16 aa, Artificial Sequence
  Description of Artificial Sequence: Synthetic peptide
  N-term Ac
  MOD_RES (7)..(7): L-cysteine connected by an i to i+7, eight-methylene crosslinker to another thiol-containing amino acid
  misc_feature (7)..(14): Crosslink between residues
  MOD_RES (14)..(14): D-cysteine connected by an i to i+7, eight-methylene crosslinker to another thiol-containing amino acid
  C-term NH2
QSQQTFCNLWRLLCQN

SEQ ID NO: 974 - protein, 16 aa, Artificial Sequence
  Description of Artificial Sequence: Synthetic peptide
  N-term Ac
  MOD_RES (7)..(7): D-cysteine connected by an i to i+7, eight-methylene crosslinker to another thiol-containing amino acid
  misc_feature (7)..(14): Crosslink between residues
  MOD_RES (14)..(14): L-cysteine connected by an i to i+7, eight-methylene crosslinker to another thiol-containing amino acid
  C-term NH2
QSQQTFCNLWALLCAN

SEQ ID NO: 975 - protein, 16 aa, Artificial Sequence
  Description of Artificial Sequence: Synthetic peptide
  N-term Ac
  MOD_RES (2)..(2): 2-aminoisobutyric acid
  MOD_RES (7)..(7): D-cysteine connected by an i to i+7, eight-methylene crosslinker to another thiol-containing amino acid
  misc_feature (7)..(14): Crosslink between residues
  MOD_RES (14)..(14): L-cysteine connected by an i to i+7, eight-methylene crosslinker to another thiol-containing amino acid
  C-term NH2
QXQQTFCNLWALLCAN

SEQ ID NO: 976 - protein, 16 aa, Artificial Sequence
  Description of Artificial Sequence: Synthetic peptide
  N-term Ac
  MOD_RES (2)..(2): 2-aminoisobutyric acid
  MOD_RES (7)..(7): D-cysteine connected by an i to i+7, eight-methylene crosslinker to another thiol-containing amino acid
  misc_feature (7)..(14): Crosslink between residues
  MOD_RES (14)..(14): L-cysteine connected by an i to i+7, eight-methylene crosslinker to another thiol-containing amino acid
  C-term NH2
QXQQTFCALWALLCAN

SEQ ID NO: 977 - protein, 16 aa, Artificial Sequence
  Description of Artificial Sequence: Synthetic peptide
  N-term Ac
  MOD_RES (7)..(7): D-penicillamine connected by an i to i+7, eight-methylene crosslinker to another thiol-containing amino acid
  misc_feature (7)..(14): Crosslink between residues
  MOD_RES (14)..(14): L-penicillamine connected by an i to i+7, eight-methylene crosslinker to another thiol-containing amino acid
  C-term NH2
QSQQTFXNLWRLLXQN

SEQ ID NO: 978 - protein, 16 aa, Artificial Sequence
  Description of Artificial Sequence: Synthetic peptide
  N-term Ac
  MOD_RES (7)..(7): D-penicillamine connected by an i to i+7, eight-methylene crosslinker to another thiol-containing amino acid
  misc_feature (7)..(14): Crosslink between residues
  MOD_RES (14)..(14): L-cysteine connected by an i to i+7, eight-methylene crosslinker to another thiol-containing amino acid
  C-term NH2
QSQQTFXNLWRLLCQN

SEQ ID NO: 979 - protein, 16 aa, Artificial Sequence
  Description of Artificial Sequence: Synthetic peptide
  N-term Ac
  MOD_RES (7)..(7): Alpha-methyl-D-cysteine connected by an i to i+7, nine-methylene crosslinker to another thiol-containing amino acid
  misc_feature (7)..(14): Crosslink between residues
  MOD_RES (14)..(14): Alpha-methyl-L-cysteine connected by an i to i+7, nine-methylene crosslinker to another thiol-containing amino acid
  C-term NH2
QSQQTFCNLWRLLCQN

SEQ ID NO: 980 - protein, 12 aa, Artificial Sequence
  Description of Artificial Sequence: Synthetic peptide
  N-term Ac
  MOD_RES (4)..(4): D-cysteine connected by an i to i+7, eight-methylene crosslinker to another thiol-containing amino acid
  misc_feature (4)..(11): Crosslink between residues
  MOD_RES (11)..(11): L-cysteine connected by an i to i+7, eight-methylene crosslinker to another thiol-containing amino acid
  C-term NH2
LTFCHYWAQLCS

SEQ ID NO: 981 - protein, 12 aa, Artificial Sequence
  Description of Artificial Sequence: Synthetic peptide
  N-term Ac
  MOD_RES (4)..(4): D-cysteine connected by an i to i+7, eight-methylene crosslinker to another thiol-containing amino acid
  misc_feature (4)..(11): Crosslink between residues
  MOD_RES (11)..(11): L-cysteine connected by an i to i+7, eight-methylene crosslinker to another thiol-containing amino acid
  C-term NH2
LTFCHYWAQICS

SEQ ID NO: 982 - protein, 12 aa, Artificial Sequence
  Description of Artificial Sequence: Synthetic peptide
  N-term Ac
  MOD_RES (4)..(4): D-cysteine connected by an i to i+7, eight-methylene crosslinker to another thiol-containing amino acid
  misc_feature (4)..(11): Crosslink between residues
  MOD_RES (10)..(10): Norleucine
  MOD_RES (11)..(11): L-cysteine connected by an i to i+7, eight-methylene crosslinker to another thiol-containing amino acid
  C-term NH2
LTFCHYWAQLCS

SEQ ID NO: 983 - protein, 12 aa, Artificial Sequence
  Description of Artificial Sequence: Synthetic peptide
  N-term Ac
  MOD_RES (4)..(4): D-cysteine connected by an i to i+7, eight-methylene crosslinker to another thiol-containing amino acid
  misc_feature (4)..(11): Crosslink between residues
  MOD_RES (11)..(11): L-cysteine connected by an i to i+7, eight-methylene crosslinker to another thiol-containing amino acid
  C-term NH2
LTFCHYWAQLCA

SEQ ID NO: 984 - protein, 12 aa, Artificial Sequence
  Description of Artificial Sequence: Synthetic peptide
  N-term Ac
  MOD_RES (4)..(4): D-cysteine connected by an i to i+7, eight-methylene crosslinker to another thiol-containing amino acid
  misc_feature (4)..(11): Crosslink between residues
  MOD_RES (8)..(8): Abu
  MOD_RES (11)..(11): L-cysteine connected by an i to i+7, eight-methylene crosslinker to another thiol-containing amino acid
  C-term NH2
LTFCHYWXQLCS

SEQ ID NO: 985 - protein, 12 aa, Artificial Sequence
  Description of Artificial Sequence: Synthetic peptide
  N-term Ac
  MOD_RES (4)..(4): D-cysteine connected by an i to i+7, eight-methylene crosslinker to another thiol-containing amino acid
  misc_feature (4)..(11): Crosslink between residues
  MOD_RES (11)..(11): L-cysteine connected by an i to i+7, eight-methylene crosslinker to another thiol-containing amino acid
  C-term NH2
LTFCAYWAQLCS

SEQ ID NO: 986 - protein, 12 aa, Artificial Sequence
  Description of Artificial Sequence: Synthetic peptide
  N-term Ac
  MOD_RES (4)..(4): D-cysteine connected by an i to i+7, eight-methylene crosslinker to another thiol-containing amino acid
  misc_feature (4)..(11): Crosslink between residues
  MOD_RES (11)..(11): L-cysteine connected by an i to i+7, eight-methylene crosslinker to another thiol-containing amino acid
  C-term NH2
LTFCAYWAQLCA

SEQ ID NO: 987 - protein, 12 aa, Artificial Sequence
  Description of Artificial Sequence: Synthetic peptide
  N-term Ac
  MOD_RES (4)..(4): D-cysteine connected by an i to i+7, eight-methylene crosslinker to another thiol-containing amino acid
  misc_feature (4)..(11): Crosslink between residues
  MOD_RES (11)..(11): L-penicillamine connected by an i to i+7, eight-methylene crosslinker to another thiol-containing amino acid
  C-term NH2
LTFCHYWAQLXS

SEQ ID NO: 988 - protein, 12 aa, Artificial Sequence
  Description of Artificial Sequence: Synthetic peptide
  N-term Ac
  MOD_RES (4)..(4): D-penicillamine connected by an i to i+7, eight-methylene crosslinker to another thiol-containing amino acid
  misc_feature (4)..(11): Crosslink between residues
  MOD_RES (11)..(11): L-penicillamine connected by an i to i+7, eight-methylene crosslinker to another thiol-containing amino acid
  C-term NH2
LTFXHYWAQLXS

SEQ ID NO: 989 - protein, 12 aa, Artificial Sequence
  Description of Artificial Sequence: Synthetic peptide
  N-term Ac
  MOD_RES (4)..(4): D-penicillamine connected by an i to i+7, eight-methylene crosslinker to another thiol-containing amino acid
  misc_feature (4)..(11): Crosslink between residues
  MOD_RES (11)..(11): L-cysteine connected by an i to i+7, eight-methylene crosslinker to another thiol-containing amino acid
  C-term NH2
LTFXHYWAQLCS

SEQ ID NO: 990 - protein, 12 aa, Artificial Sequence
  Description of Artificial Sequence: Synthetic peptide
  N-term Ac
  MOD_RES (4)..(4): D-cysteine connected by an i to i+7, seven- methylene crosslinker to another thiol-containing amino acid
  misc_feature (4)..(11): Crosslink between residues
  MOD_RES (11)..(11): h-L-cysteine connected by an i to i+7, seven-methylene crosslinker to another thiol-containing amino acid
  C-term NH2
LTFCHYWAQLCS

SEQ ID NO: 991 - protein, 12 aa, Artificial Sequence
  Description of Artificial Sequence: Synthetic peptide
  N-term Ac
  MOD_RES (4)..(4): Alpha-methyl-D-cysteine connected by an i to i+7, eight-methylene crosslinker to another thiol-containing amino acid
  misc_feature (4)..(11): Crosslink between residues
  MOD_RES (11)..(11): Alpha-methyl-L-cysteine connected by an i to i+7, eight-methylene crosslinker to another thiol-containing amino acid
  C-term NH2
LTFCHYWAQLCS

SEQ ID NO: 992 - protein, 12 aa, Artificial Sequence
  Description of Artificial Sequence: Synthetic peptide
  N-term Ac
  MOD_RES (4)..(4): Alpha-methyl-D-cysteine connected by an i to i+7, nine-methylene crosslinker to another thiol-containing amino acid
  misc_feature (4)..(11): Crosslink between residues
  MOD_RES (11)..(11): Alpha-methyl-L-cysteine connected by an i to i+7, nine-methylene crosslinker to another thiol-containing amino acid
  C-term NH2
LTFCHYWAQLCS

SEQ ID NO: 993 - protein, 12 aa, Artificial Sequence
  Description of Artificial Sequence: Synthetic peptide
  N-term Ac
  MOD_RES (4)..(4): Alpha-methyl-D-cysteine connected by an i to i+7, ten-methylene crosslinker to another thiol-containing amino acid
  misc_feature (4)..(11): Crosslink between residues
  MOD_RES (11)..(11): Alpha-methyl-L-cysteine connected by an i to i+7, ten-methylene crosslinker to another thiol-containing amino acid
  C-term NH2
LTFCHYWAQLCS

SEQ ID NO: 994 - protein, 12 aa, Artificial Sequence
  Description of Artificial Sequence: Synthetic peptide
  N-term Ac
  MOD_RES (4)..(4): Alpha-methyl-D-cysteine connected by an i to i+7, seven-methylene crosslinker to another thiol-containing amino acid
  misc_feature (4)..(11): Crosslink between residues
  MOD_RES (11)..(11): Alpha-methyl-L-cysteine connected by an i to i+7, seven-methylene crosslinker to another thiol-containing amino acid
  C-term NH2
LTFCHYWAQLCS

SEQ ID NO: 995 - protein, 12 aa, Artificial Sequence
  Description of Artificial Sequence: Synthetic peptide
  N-term Ac
  MOD_RES (4)..(4): Alpha-methyl-D-cysteine connected by an i to i+7, four-methylene crosslinker to another thiol-containing amino acid-BEB
  misc_feature (4)..(11): Crosslink between residues
  MOD_RES (11)..(11): Alpha-methyl-L-cysteine connected by an i to i+7, four-methylene crosslinker to another thiol-containing amino acid-BEB
  C-term NH2
LTFCHYWAQLCS

SEQ ID NO: 996 - protein, 10 aa, Artificial Sequence
  Description of Artificial Sequence: Synthetic peptide
  N-term Ac
  MOD_RES (2)..(2): D-penicillamine connected by an i to i+7, eight-methylene crosslinker to another thiol-containing amino acid
  misc_feature (2)..(9): Crosslink between residues
  MOD_RES (7)..(7): Ac3c
  MOD_RES (9)..(9): L-cysteine connected by an i to i+7, eight-methylene crosslinker to another thiol-containing amino acid
  C-term NH2
FXAYWEXLCA

SEQ ID NO: 997 - protein, 10 aa, Artificial Sequence
  Description of Artificial Sequence: Synthetic peptide
  N-term Ac
  MOD_RES (2)..(2): D-cysteine connected by an i to i+7, eight-methylene crosslinker to another thiol-containing amino acid
  misc_feature (2)..(9): Crosslink between residues
  MOD_RES (7)..(7): Ac3c
  MOD_RES (9)..(9): L-cysteine connected by an i to i+7, eight-methylene crosslinker to another thiol-containing amino acid
  C-term NH2
FCAYWEXLCA

SEQ ID NO: 998 - protein, 10 aa, Artificial Sequence
  Description of Artificial Sequence: Synthetic peptide
  N-term Ac
  MOD_RES (2)..(2): Alpha-methyl-D-cysteine connected by an i to i+7, eight-methylene crosslinker to another thiol-containing amino acid
  misc_feature (2)..(9): Crosslink between residues
  MOD_RES (7)..(7): Ac3c
  MOD_RES (9)..(9): Alpha-methyl-L-cysteine connected by an i to i+7, eight-methylene crosslinker to another thiol-containing amino acid
  C-term NH2
FCAYWEXLCA

SEQ ID NO: 999 - protein, 12 aa, Artificial Sequence
  Description of Artificial Sequence: Synthetic peptide
  N-term Ac
  C-term NH2
LTFEHYWAQLTS

SEQ ID NO: 1000 - protein, 12 aa, Artificial Sequence
  Description of Artificial Sequence: Synthetic peptide
LTFEHYWAQLTS

SEQ ID NO: 1001 - protein, 12 aa, Artificial Sequence
  Description of Artificial Sequence: Synthetic peptide
LTFCHYWAQLCS

SEQ ID NO: 1002 - protein, 12 aa, Artificial Sequence
  Description of Artificial Sequence: Synthetic peptide
  MOD_RES (4)..(4): L-cysteine connected by an i to i+7, Bph (4,4'-bismethyl-biphenyl) crosslinker to another thiol-containing amino acid
  misc_feature (4)..(11): Crosslink between residues
  MOD_RES (11)..(11): L-cysteine connected by an i to i+7, Bph (4,4'-bismethyl-biphenyl) crosslinker to another thiol-containing amino acid
LTFCHYWAQLCS

SEQ ID NO: 1003 - protein, 12 aa, Artificial Sequence
  Description of Artificial Sequence: Synthetic peptide
  MOD_RES (4)..(4): L-cysteine connected by an i to i+7, Bpy (6,6'-bismethyl-[3,3']bipyridine) crosslinker to another thiol-containing amino acid
  misc_feature (4)..(11): Crosslink between residues
  MOD_RES (11)..(11): L-cysteine connected by an i to i+7, Bpy (6,6'-bismethyl-[3,3']bipyridine) crosslinker to another thiol-containing amino acid
LTFCHYWAQLCS

SEQ ID NO: 1004 - protein, 12 aa, Artificial Sequence
  Description of Artificial Sequence: Synthetic peptide
LTFCRYWARLCS

SEQ ID NO: 1005 - protein, 12 aa, Artificial Sequence
  Description of Artificial Sequence: Synthetic peptide
  MOD_RES (4)..(4): L-cysteine connected by an i to i+7, Bph (4,4'-bismethyl-biphenyl) crosslinker to another thiol-containing amino acid
  misc_feature (4)..(11): Crosslink between residues
  MOD_RES (11)..(11): L-cysteine connected by an i to i+7, Bph (4,4'-bismethyl-biphenyl) crosslinker to another thiol-containing amino acid
LTFCRYWARLCS

SEQ ID NO: 1006 - protein, 12 aa, Artificial Sequence
  Description of Artificial Sequence: Synthetic peptide
  MOD_RES (4)..(4): L-cysteine connected by an i to i+7, Bpy (6,6'-bismethyl-[3,3']bipyridine) crosslinker to another thiol-containing amino acid
  misc_feature (4)..(11): Crosslink between residues
  MOD_RES (11)..(11): L-cysteine connected by an i to i+7, Bpy (6,6'-bismethyl-[3,3']bipyridine) crosslinker to another thiol-containing amino acid
LTFCRYWARLCS

SEQ ID NO: 1007 - protein, 12 aa, Artificial Sequence
  Description of Artificial Sequence: Synthetic peptide
  MOD_RES (4)..(4): D-amino acid
LTFCHYWAQLCS

SEQ ID NO: 1008 - protein, 12 aa, Artificial Sequence
  Description of Artificial Sequence: Synthetic peptide
  MOD_RES (4)..(4): D-cysteine connected by an i to i+7, Bph (4,4'-bismethyl-biphenyl) crosslinker to another thiol-containing amino acid
  misc_feature (4)..(11): Crosslink between residues
  MOD_RES (11)..(11): L-cysteine connected by an i to i+7, Bph (4,4'-bismethyl-biphenyl) crosslinker to another thiol-containing amino acid
LTFCHYWAQLCS

SEQ ID NO: 1009 - protein, 12 aa, Artificial Sequence
  Description of Artificial Sequence: Synthetic peptide
  MOD_RES (4)..(4): D-cysteine connected by an i to i+7, Bpy (6,6'-bismethyl-[3,3']bipyridine) crosslinker to another thiol-containing amino acid
  misc_feature (4)..(11): Crosslink between residues
  MOD_RES (11)..(11): D-cysteine connected by an i to i+7, Bpy (6,6'-bismethyl-[3,3']bipyridine) crosslinker to another thiol-containing amino acid
LTFCHYWAQLCS

SEQ ID NO: 1010 - protein, 12 aa, Artificial Sequence
  Description of Artificial Sequence: Synthetic peptide
  MOD_RES (4)..(4): D-cysteine connected by an i to i+7, Bph (4,4'-bismethyl-biphenyl) crosslinker to another thiol-containing amino acid
  misc_feature (4)..(11): Crosslink between residues
  MOD_RES (11)..(11): L-cysteine connected by an i to i+7, Bph (4,4'-bismethyl-biphenyl) crosslinker to another thiol-containing amino acid
LTFCRYWARLCS

SEQ ID NO: 1011 - protein, 12 aa, Artificial Sequence
  Description of Artificial Sequence: Synthetic peptide
  MOD_RES (4)..(4): D-cysteine connected by an i to i+7, Bpy (6,6'-bismethyl-[3,3']bipyridine) crosslinker to another thiol-containing amino acid
  misc_feature (4)..(11): Crosslink between residues
  MOD_RES (11)..(11): L-cysteine connected by an i to i+7, Bpy (6,6'-bismethyl-[3,3']bipyridine) crosslinker to another thiol-containing amino acid
LTFCRYWARLCS

SEQ ID NO: 1012 - protein, 13 aa, Artificial Sequence
  Description of Artificial Sequence: Synthetic peptide
  N-term 5-FAM
  MOD_RES (1)..(1): Beta-Ala
  C-term NH2
ALTFEHYWAQLTS

SEQ ID NO: 1013 - protein, 6 aa, Artificial Sequence
  Description of Artificial Sequence: Synthetic 6xHis tag
HHHHHH

---

What is claimed is:

1. A peptidomimetic macrocycle comprising an amino acid sequence which is at least 90% identical to an amino acid sequence of SEQ ID NO. 455, wherein the peptidomimetic macrocycle has the formula:

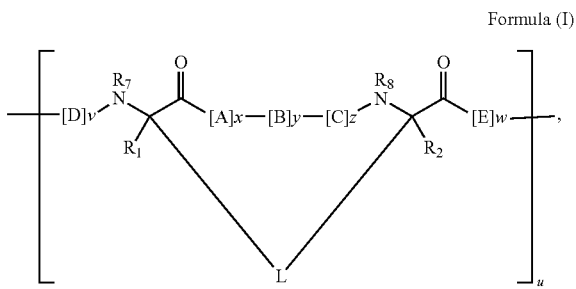

Formula (I)

an isomer or pharmaceutically acceptable salt thereof wherein:

each A, C, D, and E is independently an amino acid;
each B is independently an amino acid,

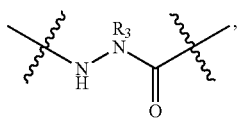

[—NH-$L_3$-CO—], [—NH-$L_3$-$SO_2$—], or [—NH-$L_3$-];

each $R_1$ and $R_2$ is independently —H, alkyl, alkenyl, alkynyl, arylalkyl, cycloalkyl, cycloalkylalkyl, heteroalkyl, or heterocycloalkyl, unsubstituted or substituted with halo-; or at least one of $R_1$ and $R_2$ forms a macrocycle-forming linker L' connected to the alpha position of one of said D or E amino acids;

each L and L' is independently a macrocycle-forming linker of the formula

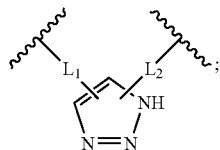

each $L_1$, $L_2$ and $L_3$ is independently alkylene, alkenylene, alkynylene, heteroalkylene, cycloalkylene, heterocycloalkylene, cycloarylene, heterocycloarylene, or [—$R_4$—K—$R_4$—]$_n$, each being optionally substituted with $R_5$;

each $R_3$ is independently hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;

each $R_4$ is independently alkylene, alkenylene, alkynylene, heteroalkylene, cycloalkylene, heterocycloalkylene, arylene, or heteroarylene;

each K is independently O, S, SO, $SO_2$, CO, $CO_2$, or $CONR_3$;

each $R_5$ is independently halogen, alkyl, —$OR_6$, —$N(R_6)_2$, —$SR_6$, —$SOR_6$, —$SO_2R_6$, —$CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

each $R_7$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;

each $R_8$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

v is an integer from 1-1000;
w is an integer from 3-1000;

u is an integer from 1-10;
each x, y and z is independently an integer from 0-10; and
n is an integer from 1-5.

2. The peptidomimetic macrocycle, isomer or pharmaceutically acceptable salt of claim 1, which has improved binding affinity to MDM2 or MDMX relative to a corresponding peptidomimetic macrocycle with a w of 0, 1 or 2.

3. The peptidomimetic macrocycle, isomer or pharmaceutically acceptable salt of claim 1, which has a reduced ratio of binding affinities to MDMX versus MDM2 relative to a corresponding peptidomimetic macrocycle with a w of 0, 1 or 2.

4. The peptidomimetic macrocycle, isomer or pharmaceutically acceptable salt of claim 1, which has improved in vitro anti-tumor efficacy against p53 positive tumor cell lines relative to a corresponding peptidomimetic macrocycle with a w of 0, 1 or 2.

5. The peptidomimetic macrocycle, isomer or pharmaceutically acceptable salt of claim 1, which shows improved in vitro induction of apoptosis in p53 positive tumor cell lines relative to a corresponding peptidomimetic macrocycle with a w of 0, 1 or 2.

6. The peptidomimetic macrocycle, isomer or pharmaceutically acceptable salt of claim 1, which has an improved in vitro anti-tumor efficacy ratio for p53 positive versus p53 negative or mutant tumor cell lines relative to a corresponding peptidomimetic macrocycle with a w of 0, 1 or 2.

7. The peptidomimetic macrocycle, isomer or pharmaceutically acceptable salt of claim 1, which has improved in vivo anti-tumor efficacy against p53 positive tumors relative to a corresponding peptidomimetic macrocycle with a w of 0, 1 or 2.

8. The peptidomimetic macrocycle, isomer or pharmaceutically acceptable salt of claim 1, which has improved in vivo induction of apoptosis in p53 positive tumors relative to a corresponding peptidomimetic macrocycle with a w of 0, 1 or 2.

9. The peptidomimetic macrocycle, isomer or pharmaceutically acceptable salt of claim 1, which has improved cell permeability relative to a corresponding peptidomimetic macrocycle with a w of 0, 1 or 2.

10. The peptidomimetic macrocycle, isomer or pharmaceutically acceptable salt of claim 1, which has improved solubility relative to a corresponding peptidomimetic macrocycle with a w of 0, 1 or 2.

11. The peptidomimetic macrocycle, isomer or pharmaceutically acceptable salt of claim 1, wherein each E is independently an amino acid selected from Ala (alanine), D-Ala (D-alanine), Aib (α-aminoisobutyric acid), Sar (N-methyl glycine), and Ser (serine).

12. The peptidomimetic macrocycle, isomer or pharmaceutically acceptable salt of claim 1, wherein $[D]_v$ is -Leu$_1$-Thr$_2$-Phe$_3$.

13. The peptidomimetic macrocycle, isomer or pharmaceutically acceptable salt of claim 1, wherein w is 3-10.

14. The peptidomimetic macrocycle, isomer or pharmaceutically acceptable salt of claim 13, wherein w is 3-6.

15. The peptidomimetic macrocycle, isomer or pharmaceutically acceptable salt of claim 13, wherein w is 6-10.

16. The peptidomimetic macrocycle, isomer or pharmaceutically acceptable salt of claim 15, wherein w is 6.

17. The peptidomimetic macrocycle, isomer or pharmaceutically acceptable salt of claim 1, wherein v is 1-10.

18. The peptidomimetic macrocycle, isomer or pharmaceutically acceptable salt of claim 17, wherein v is 2-10.

19. The peptidomimetic macrocycle, isomer or pharmaceutically acceptable salt of claim 18, wherein v is 2-5.

20. The peptidomimetic macrocycle, isomer or pharmaceutically acceptable salt of claim 18, wherein v is 2.

21. The peptidomimetic macrocycle, isomer or pharmaceutically acceptable salt of claim 1, wherein each E is independently Ser or Ala or an analog of Ser or Ala.

22. The peptidomimetic macrocycle, isomer or pharmaceutically acceptable salt of claim 1, comprising at least one amino acid which is an amino acid analog.

23. A method of treating cancer in a subject comprising administering to the subject a peptidomimetic macrocycle, isomer or pharmaceutically acceptable salt of claim 1.

24. A method of modulating the activity of p53 and/or MDM2 and/or MDMX in a subject comprising administering to the subject a peptidomimetic macrocycle, isomer or pharmaceutically acceptable salt of claim 1.

25. A method of antagonizing the interaction between p53 and MDM2 and/or between p53 and MDMX proteins in a subject comprising administering to the subject a peptidomimetic macrocycle, isomer or pharmaceutically acceptable salt of claim 1.

26. The peptidomimetic macrocycle of claim 1, which is at least 95% identical to an amino acid sequence of SEQ ID NO. 455, an isomer or pharmaceutically acceptable salt thereof.

27. The peptidomimetic macrocycle, isomer or pharmaceutically acceptable salt of claim 1, wherein v is an integer from 1-500.

28. The peptidomimetic macrocycle, isomer or pharmaceutically acceptable salt of claim 1, wherein v is an integer from 1-200.

29. The peptidomimetic macrocycle, isomer or pharmaceutically acceptable salt of claim 1, wherein v is an integer from 1-100.

30. The peptidomimetic macrocycle, isomer or pharmaceutically acceptable salt of claim 1, wherein v is an integer from 1-50.

31. The peptidomimetic macrocycle, isomer or pharmaceutically acceptable salt of claim 1, wherein v is an integer from 1-30.

32. The peptidomimetic macrocycle, isomer or pharmaceutically acceptable salt of claim 1, wherein the sum of x+y+z is 2, 3, or 6.

33. The peptidomimetic macrocycle, isomer or pharmaceutically acceptable salt of claim 1, wherein w is an integer from 3-500.

34. The peptidomimetic macrocycle, isomer or pharmaceutically acceptable salt of claim 1, wherein w is an integer from 3-200.

35. The peptidomimetic macrocycle, isomer or pharmaceutically acceptable salt of claim 1, wherein w is an integer from 3-100.

36. The peptidomimetic macrocycle, isomer or pharmaceutically acceptable salt of claim 1, wherein w is an integer from 3-50.

37. The peptidomimetic macrocycle, isomer or pharmaceutically acceptable salt of claim 1 or 32, wherein w is an integer from 3-30.

38. The peptidomimetic macrocycle, isomer or pharmaceutically acceptable salt of claim 1 or 31, wherein w is an integer from 3-20.

39. The peptidomimetic macrocycle, isomer or pharmaceutically acceptable salt of claims 1 or 32, wherein v is an integer from 1-20.

40. The peptidomimetic macrocycle, isomer or pharmaceutically acceptable salt of claim 1, wherein u is an integer from 1-5.

41. The peptidomimetic macrocycle, isomer or pharmaceutically acceptable salt of claim 1 or 31, wherein u is an integer from 1-3.

42. The peptidomimetic macrocycle, isomer or pharmaceutically acceptable salt of claim 1 or 32, wherein u is an integer from 1-2.

43. The peptidomimetic macrocycle of claim 1, consisting of an amino acid sequence of SEQ ID NO. 455, an isomer or pharmaceutically acceptable salt thereof.

44. A pharmaceutical composition comprising the peptidomimetic macrocycle, isomer or pharmaceutically acceptable salt of any one of claims 1, 26, and 43.

* * * * *